United States Patent 11,931,406 (FLAVIVIRUS VACCINE) - sequence listing, part 3

SEQ ID NO: 2829 - protein, 3292 aa, Artificial Sequence
  derived and/or modified protein sequence (wt) from DENV-1__GQ868534__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKNAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2830 - protein, 3292 aa, Artificial Sequence
  derived and/or modified protein sequence (wt) from DENV-1__GQ868535__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVANPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNMGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2831 - protein, 3292 aa, Artificial Sequence
  derived and/or modified protein sequence (wt) from DENV-1__KJ189306__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLERAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFHIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2832 - protein, 3292 aa, Artificial Sequence
  derived and/or modified protein sequence (wt) from DENV-1__KJ189307__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNIPVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKNAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2833 - protein, 3292 aa, Artificial Sequence
  derived and/or modified protein sequence (wt) from DENV-1__KJ189318__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKTAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2834 - protein, 3292 aa, Artificial Sequence
  derived and/or modified protein sequence (wt) from DENV-1__KJ189319__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSLGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2835 - protein, 3292 aa, Artificial Sequence
  derived and/or modified protein sequence (wt) from DENV-1__KJ189320__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2836 - protein, 3292 aa, Artificial Sequence
  derived and/or modified protein sequence (wt) from DENV-1__KJ189323__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQGGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVRPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2837 - protein, 3292 aa, Artificial Sequence
  derived and/or modified protein sequence (wt) from DENV-1__KJ189324__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEEIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2838 - protein, 3292 aa, Artificial Sequence
  derived and/or modified protein sequence (wt) from DENV-1__KJ189325__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2839 - protein, 3292 aa, Artificial Sequence
  derived and/or modified protein sequence (wt) from DENV-1__KJ189326__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2840 - protein, 3292 aa, Artificial Sequence
  derived and/or modified protein sequence (wt) from DENV-1__KJ189327__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2841 - protein, 3292 aa, Artificial Sequence
  derived and/or modified protein sequence (wt) from DENV-1__KJ189328__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFHPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAIEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2842 - protein, 3292 aa, Artificial Sequence
  derived and/or modified protein sequence (wt) from DENV-1__KJ189329__SS-prME
SVTMLLMLLPTALAFHLTTRGGEPHMIVSKQERGKSLLFKTSAGVNMCTLIAMDLGELCEDTMTYKCPQITEAEPDDVDCWCNATDAWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRSGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTSRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYRTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2843 - protein, 3292 aa, Artificial Sequence
  derived and/or modified protein sequence (wt) from DENV-1__KJ189331__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMIGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKTAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLAMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2844 - protein, 3292 aa, Artificial Sequence
  derived and/or modified protein sequence (wt) from DENV-1__KJ189332__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKTAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLAMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2845 - protein, 3292 aa, Artificial Sequence
  derived and/or modified protein sequence (wt) from DENV-1__KJ189334__SS-prME
SVTMLLMLLPTALAFHLTTRGGEPHMIVSKQERGKSLLFKVSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKNAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2846 - protein, 3292 aa, Artificial Sequence
  derived and/or modified protein sequence (wt) from DENV-1__KJ189335__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKNAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2847 - protein, 3292 aa, Artificial Sequence
  derived and/or modified protein sequence (wt) from DENV-1__KJ189336__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGIVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2848 - protein, 3292 aa, Artificial Sequence
  derived and/or modified protein sequence (wt) from DENV-1__KJ189337__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQEIWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKRKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENVKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2849 - protein, 3292 aa, Artificial Sequence
  derived and/or modified protein sequence (wt) from DENV-1__KJ189340__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTGGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2850 - protein, 3292 aa, Artificial Sequence
  derived and/or modified protein sequence (wt) from DENV-1__KJ189341__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGGHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIVVGIVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPSTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGIQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVELHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2851 - protein, 3292 aa, Artificial Sequence
  derived and/or modified protein sequence (wt) from DENV-1__KJ189343__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMIGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKTAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLAMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2852 - protein, 3292 aa, Artificial Sequence
  derived and/or modified protein sequence (wt) from DENV-1__KJ189344__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2853 - protein, 3292 aa, Artificial Sequence
  derived and/or modified protein sequence (wt) from DENV-1__KJ189346__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVMESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFLWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTSRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLAKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTTAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDILQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2854 - protein, 3292 aa, Artificial Sequence
  derived and/or modified protein sequence (wt) from DENV-1__KJ189347__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLMASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVRPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGRCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2855 - protein, 3292 aa, Artificial Sequence
  derived and/or modified protein sequence (wt) from DENV-1__KJ189348__SS-prME
SVTMLLMLLPTALAFHLTTRGGEPHMIVSKHERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSFSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2856 - protein, 3292 aa, Artificial Sequence
  derived and/or modified protein sequence (wt) from DENV-1__KJ189368__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQNGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEFMEPEHALLATSIFKLTYQNKVVRVQRPAKNGTVMDVISRRDQRGSGQVGTYGLNTFTNMEVQLIRQMESEGIFLPSELETPNLAERVFDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2857 - protein, 3292 aa, Artificial Sequence
  derived and/or modified protein sequence (wt) from DENV-1__KJ189369__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKNAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2858 - protein, 3292 aa, Artificial Sequence
  derived and/or modified protein sequence (wt) from DENV-1__EU482615__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKSESDPEGALW

SEQ ID NO: 2859 - protein, 3292 aa, Artificial Sequence
  derived and/or modified protein sequence (wt) from DENV-1__EU482616__SS-prME
SVTMLLMLLPTALAFHLTTRGGEPHMIVNKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2860 - protein, 3292 aa, Artificial Sequence
  derived and/or modified protein sequence (wt) from DENV-1__EU482618__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2861 - protein, 3292 aa, Artificial Sequence
  derived and/or modified protein sequence (wt) from DENV-1__EU482619__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2862 - protein, 3292 aa, Artificial Sequence
  derived and/or modified protein sequence (wt) from DENV-1__FJ898433__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRREKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDSCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFHPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLGKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2863 - protein, 3292 aa, Artificial Sequence
  derived and/or modified protein sequence (wt) from DENV-1__FJ547088__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAGRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2864 - protein, 3292 aa, Artificial Sequence
  derived and/or modified protein sequence (wt) from DENV-1__FJ810419__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2865 - protein, 3292 aa, Artificial Sequence
  derived and/or modified protein sequence (wt) from DENV-1__FJ547068__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLAASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2866 - protein, 3292 aa, Artificial Sequence
  derived and/or modified protein sequence (wt) from DENV-1__FJ562104__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2867 - protein, 3292 aa, Artificial Sequence
  derived and/or modified protein sequence (wt) from DENV-1__GQ199857__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2868 - protein, 3292 aa, Artificial Sequence
  derived and/or modified protein sequence (wt) from DENV-1__GQ199858__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGLGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2869 - protein, 3292 aa, Artificial Sequence
  derived and/or modified protein sequence (wt) from DENV-1__GQ199859__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMYLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2870 - protein, 3292 aa, Artificial Sequence
  derived and/or modified protein sequence (wt) from DENV-1__JF937645__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2871 - protein, 3292 aa, Artificial Sequence
  derived and/or modified protein sequence (wt) from DENV-1__FJ850114__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTSPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKTYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEILEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMISMKRFKNESDPEGALW

SEQ ID NO: 2872 - protein, 3292 aa, Artificial Sequence
  derived and/or modified protein sequence (wt) from DENV-1__JN819402__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMTNIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRLMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKSESDPEGALW

SEQ ID NO: 2873 - protein, 3292 aa, Artificial Sequence
  derived and/or modified protein sequence (wt) from DENV-1__FJ850113__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRLMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKSESDPEGALW

SEQ ID NO: 2874 - protein, 3292 aa, Artificial Sequence
  derived and/or modified protein sequence (wt) from DENV-1__JF937635__SS-prME
SVTMLLMLMPTALAFHLTTRGGEPHMIVSKHERGKALLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKTSQEGPPPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2875 - protein, 3292 aa, Artificial Sequence
  derived and/or modified protein sequence (wt) from DENV-1__FJ024483__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYYTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2876 - protein, 3292 aa, Artificial Sequence
  derived and/or modified protein sequence (wt) from DENV-1__EU596504__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCFAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFMPPEKCDTLLCDIGESSPNPTIEEGRTLRILKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2877 - protein, 3292 aa, Artificial Sequence
  derived and/or modified protein sequence (wt) from DENV-1__FJ024481__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFMPPEKCDTLLCDIGESSPNPTIEEGRTLRILKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2878 - protein, 3292 aa, Artificial Sequence
  derived and/or modified protein sequence (wt) from DENV-1__GQ199872__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDHMTSMKRFKNESDPEGALW

SEQ ID NO: 2879 - protein, 3292 aa, Artificial Sequence
  derived and/or modified protein sequence (wt) from DENV-1__FJ410290__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTSPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLVVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRFEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVKLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLGKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLATNAKCSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMRRFKNESDPEGALW

SEQ ID NO: 2880 - protein, 3292 aa, Artificial Sequence
  derived and/or modified protein sequence (wt) from DENV-1__FJ024423__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVVAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2881 - protein, 3292 aa, Artificial Sequence
  derived and/or modified protein sequence (wt) from DENV-1__FJ547089__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKTIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGVPAREEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2882 - protein, 3292 aa, Artificial Sequence
  derived and/or modified protein sequence (wt) from DENV-1__FJ024484__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVVAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRAARVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLTKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDGFFMPPEKCGTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2883 - protein, 3292 aa, Artificial Sequence
  derived and/or modified protein sequence (wt) from DENV-1__EU596503__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCIGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGMFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLITGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2884 - protein, 3292 aa, Artificial Sequence
  derived and/or modified protein sequence (wt) from DENV-1__FJ024479__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGFFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTAAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRAARVIDPRRCLKPVILKDGPERVILAGPMPVTVASAAQRRGRIGRNQNKEGDQYVYMGQPLNNDEDHAHWTEAKMLLDNITTPEGIIPALFEPEREKSAAIDGESRLRGEPRKTFVELMRRGDLPVWLSYKVASEGFQYSDRRWCFDGERNNQVLEENMDVEIWPKEGERKKLRPRWLDARTYSDPLALGEFKEFGAGRRSGSGALILEIGKLPQHLPLRAQNGLDNLVMVHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLAKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILWTSQILLMRTTWALGESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVNPEGKVIDLGCGRGGWSYYCAGLKKVTEVKGYTKGGPGHEEPIPMATYGWNLVKLHSGKDVFFIPPEKCDTLLCDIGESSPNPTIEEGRTLRGLKMVEPWLRGNQFCIKILNPYMPSVVETLEQMQRKHGGMLVRNPLSRNSTHEMDWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVVVDENQWNSAKEAGEDERVWDLGDRERELHKQGKCATCGYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRAQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVAFWSHHFHQLIMKDGREIVVPCRNQDELGGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2885 - protein, 3292 aa, Artificial Sequence
  derived and/or modified protein sequence (wt) from DENV-1__FJ182002__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLITGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRTQTKEGDQYVYMGQPLNNDEDHAHWTEAKMLLANINTPEGIIPALFEPEREKSPAIDGEYRLRGEARKTFVELMRRGDLPVWLSYKVASEGFQYSDRRWWFDGERNNQVLEENMDVEIWTKEGERKKLRPRWLDARTYSDPLALGEFKEFGAGRRSGSGDLILEIGKLPQHLTLRAQNGLDNLVMVHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAGEDERVWDLVDRERELHKQGKWGTGGYNMMGKREKKLGEFGKAKGSRGIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMPISGDDCVVKPIDDRFATALTALNDMGKVRKDIPQWEPSKGWNDWQQVPFWSHHFHQLIMKDGREIVVPCRNQDELVGRARVSQGAGWSLRETAWLGKSYAQMGQLMYFHRRDLRLAANAIWSAGPGDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2886 - protein, 3292 aa, Artificial Sequence
  derived and/or modified protein sequence (wt) from DENV-1__FJ024482__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWPKEGERKKLRPRWLDARTYSDPLALREFKEFAAGRRSVSGDLILEIGKLPQHLTLRAQNALDNLVMVHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFLILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRAQRGSGQVGTYGLNTFTNMEVQLIRQMESEGIFLPSELETPNLAERVLDWLEKHGAERLKRMAISGDDCVVKPIDDRFATALTALNAMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2887 - protein, 3292 aa, Artificial Sequence
  derived and/or modified protein sequence (wt) from DENV-1__EU596501__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLLPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRIMQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTLEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSSHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2888 - protein, 3292 aa, Artificial Sequence
  derived and/or modified protein sequence (wt) from DENV-1__FJ898437__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHVTMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2889 - protein, 3292 aa, Artificial Sequence
  derived and/or modified protein sequence (wt) from DENV-1__FJ024480__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLMASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVKLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2890 - protein, 3292 aa, Artificial Sequence
  derived and/or modified protein sequence (wt) from DENV-1__FJ873814__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVVAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEESIPMATYAWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2891 - protein, 3292 aa, Artificial Sequence
  derived and/or modified protein sequence (wt) from DENV-1__JN819403__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEGPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2892 - protein, 3292 aa, Artificial Sequence
  derived and/or modified protein sequence (wt) from DENV-1__KF973453__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2893 - protein, 3292 aa, Artificial Sequence
  derived and/or modified protein sequence (wt) from DENV-1__KF973454__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPICLSTTSQKTTWLPVLLGSFGCKPLTMYLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQSALDNLVMLHNSEQGGKAYRHAMEELPDTIETLMLLALIAVLTGGVMLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGVLW

SEQ ID NO: 2894 - protein, 3292 aa, Artificial Sequence
  derived and/or modified protein sequence (wt) from DENV-1__KF973455__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPICLSTTSQKTTWLPVLLGSFGCKPLTMYLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVMLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2895 - protein, 3292 aa, Artificial Sequence
  derived and/or modified protein sequence (wt) from DENV-1__KF973456__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPICLSTTSQKTTWLPVLLGSFGCKPLTMYLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVMLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2896 - protein, 3292 aa, Artificial Sequence
  derived and/or modified protein sequence (wt) from DENV-1__KF973459__SS-prME
SVTMLLMLLPTALAFHLTTRGGEPHMIVSKQERGKSLLFKTSAGVNMCTLIAMDLGELCEDTLTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSLSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKVSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2897 - protein, 3292 aa, Artificial Sequence
  derived and/or modified protein sequence (wt) from DENV-1__KF973460__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSLSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMYFITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCISQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNESYLDYMTSMKRFKNESDPEGALW

SEQ ID NO: 2898 - protein, 3292 aa, Artificial Sequence
  derived and/or modified protein sequence (wt) from DENV-1__KF973461__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSMGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKITAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2899 - protein, 3292 aa, Artificial Sequence
  derived and/or modified protein sequence (wt) from DENV-1__KF973462__SS-prME
SVTMLLMLLPTALAFHLTTRGGEPHMIVSKQERGKSLLFKTSAGVNMCTLIAMDLGELCEDTLTYKCPQIIEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEMAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKVSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVRLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2900 - protein, 3292 aa, Artificial Sequence
  derived and/or modified protein sequence (wt) from DENV-1__KF973463__SS-prME
SVTMLLMLMPTALAFHLTTRGGEPHMIVSKHERGKALLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKKKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2901 - protein, 3292 aa, Artificial Sequence
  derived and/or modified protein sequence (wt) from DENV-1__KF973464__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGIFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2902 - protein, 3292 aa, Artificial Sequence
  derived and/or modified protein sequence (wt) from DENV-1__KF973465__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSMGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2903 - protein, 3292 aa, Artificial Sequence
  derived and/or modified protein sequence (wt) from DENV-1__KF973466__SS-prME
SVTMLLMLMPTALAFHLTTRGGEPHMIVSKHERGKALLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2904 - protein, 3292 aa, Artificial Sequence
  derived and/or modified protein sequence (wt) from DENV-1__KF973471__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTPAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIISLFPLCLSTTSQKTTWLPVLLGSFGCKPLTMFLITENKIWGRKSWPLNEGIMAIGIVSILLSSLLKNDVPLAGPLTAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTVEEGRTLRVLKMVEPWLKGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2905 - protein, 3292 aa, Artificial Sequence
  derived and/or modified protein sequence (wt) from DENV-1__KF973472__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSVTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIRTTLSLDYAWKTTAMALSIVSLFPLCLSTTSQKTTWLPVLLGSFGCKPLTMYFITENKIWGRKSWPINEGIMAIGIVSILLSSLLKNDVPLAGPLIAGGMLIACYVISGSSADLSLEKAAEVSWEQEAEHSGTSHNILVEVRDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNESYLDYMTSMKRFKNESDPEGALW

SEQ ID NO: 2906 - protein, 3292 aa, Artificial Sequence
  derived and/or modified protein sequence (wt) from DENV-1__KF973474__SS-prME
SVTMLLMLLPTALAFHLTTRGGEPHMIVSKHERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALALDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKLRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMYLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPVRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2907 - protein, 3292 aa, Artificial Sequence
  derived and/or modified protein sequence (wt) from DENV-1__KF973475__SS-prME
SVTMLLMLMPTALAFHLTTRGGEPHMIVSKHERGKALLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGILFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPINEGIMAIGIVSILLSSLLKNDVPLAGPLIAGGMLIACYVISGSSADLSLEKAAEVSWEQEAEHSGTSHNILVEVQDDGTMRIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2908 - protein, 3292 aa, Artificial Sequence
  derived and/or modified protein sequence (wt) from DENV-1__FJ898448__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLDELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWHFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVTSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGTERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2909 - protein, 3292 aa, Artificial Sequence
  derived and/or modified protein sequence (wt) from DENV-1__GQ868602__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGVLAQGKKMIRPQPMEHKYSWKSWGKAKVIGADVQNITFIIDGPNTPECPDDQRAWNIWEVEDYGFGIFTTNIWLKLRDSYTQVCDHRLMSAAIKDSKAVHADMGYWIESEKNETWKLTRASFIEVKTCIWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNMGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLLKNMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRNVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNENDPEGALW

SEQ ID NO: 2910 - protein, 3292 aa, Artificial Sequence
  derived and/or modified protein sequence (wt) from DENV-1__KF921911__SS-prME
SVTMLLMLLPTALAFHLTTRGGEPHMIVSKQERGKSLLFKTSVGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWNRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVSLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVYRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2911 - protein, 3292 aa, Artificial Sequence
  derived and/or modified protein sequence (wt) from DENV-1__KJ189350__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQNGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2912 - protein, 3292 aa, Artificial Sequence
  derived and/or modified protein sequence (wt) from DENV-1__KJ189351__SS-prME
SVTMLLMLLPTVLAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTPGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLIAENRIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCVKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKSSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2913 - protein, 3292 aa, Artificial Sequence
  derived and/or modified protein sequence (wt) from DENV-1__KJ189352__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDANGILAQGKKMIRPQPMEHKYSWKSWGKAKVIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2914 - protein, 3292 aa, Artificial Sequence
  derived and/or modified protein sequence (wt) from DENV-1__KJ189353__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2915 - protein, 3292 aa, Artificial Sequence
  derived and/or modified protein sequence (wt) from DENV-1__KJ189354__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDEKFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2916 - protein, 3292 aa, Artificial Sequence
  derived and/or modified protein sequence (wt) from DENV-1__KJ189355__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVIDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSMSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALGWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2917 - protein, 3292 aa, Artificial Sequence
  derived and/or modified protein sequence (wt) from DENV-1__KJ189358__SS-prME
SVTMLLMLLPTVLAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLVASVELPNSLEELGDGLAMGIMMLKLLTEFQPYQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQRKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRKYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHAQLATSIFKLTYQNKVVRVQRPAKNGTVMDVISRRDQRGSGQVGTYGLNTFTNMEVQLIRQMESEGIFLPSELETPNLAERALDWLEKNGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2918 - protein, 3292 aa, Artificial Sequence
  derived and/or modified protein sequence (wt) from DENV-1__KJ189359__SS-prME
SVTMLLMLLPTVLAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQRKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHTTMLDVDLHPASAWTLYAVATTVITPMMRHTIENTTANISLTAIANQAAILMGLDKGWPISKIDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNTAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2919 - protein, 3292 aa, Artificial Sequence
  derived and/or modified protein sequence (wt) from DENV-1__KJ189360__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2920 - protein, 3292 aa, Artificial Sequence
  derived and/or modified protein sequence (wt) from DENV-1__KJ189361__SS-prME
SVTMLLMLLPTAMAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2921 - protein, 3292 aa, Artificial Sequence
  derived and/or modified protein sequence (wt) from DENV-1__KJ189362__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGMTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVRTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSVLLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2922 - protein, 3292 aa, Artificial Sequence
  derived and/or modified protein sequence (wt) from DENV-1__KJ189363__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFMVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2923 - protein, 3292 aa, Artificial Sequence
  derived and/or modified protein sequence (wt) from DENV-1__KJ189364__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGMTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVRTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWSFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2924 - protein, 3292 aa, Artificial Sequence
  derived and/or modified protein sequence (wt) from DENV-1__KJ189365__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIVVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIDENPWMENKTHVSSWEEVPYLGKREDQWCGSLIGLTARATWATNIQVAINQVRRLIGNENYLDYMTSMKRFKNESDSEGALW

SEQ ID NO: 2925 - protein, 3292 aa, Artificial Sequence
  derived and/or modified protein sequence (wt) from DENV-1__KJ189366__SS-prME
SVTMLLMLLPTALAFHLTTRGGEPHMIVSKQERGKSLLFKTSAGVNMCTLIAMDLGELCEDTMTYKCPRIAEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNSDWDYVVTTDISEMGANFRADRVIDPRRCLKPVILKDGPERVILAGPMPVTAASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHVTMLDVDLHPASAWTLYAVATTVITPMMRHTIENATANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTVEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAVGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRVTEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWEEVPYLGKREDQWCGSLIGLTARATWATNIQVAINQVRRLIGNENYLDYMTSMKRFKNESDSEGALW

SEQ ID NO: 2926 - protein, 3292 aa, Artificial Sequence
  derived and/or modified protein sequence (wt) from DENV-1__JN819417__SS-prME
SVTMLLMLLPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQHENLKYSVIVTVHTGDQHQVGNETTEHGTIATITPQAPTSEIQLTDYGALTLDCSPRTGLDFNEMVLLTMKEKSWLVHKQWFLDLPLPWTSGASTSHETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDASGILAQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMGTFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEISWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTIWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTKKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGNVMDVISRRDQRGSGQVGTYGLNTFTNMEVQLIRQMESEGIFLPSELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2927 - protein, 3292 aa, Artificial Sequence
  derived and/or modified protein sequence (wt) from DENV-1__FJ687426__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLAGASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2928 - protein, 3292 aa, Artificial Sequence
  derived and/or modified protein sequence (wt) from DENV-1__FJ687428__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLAGASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIESIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2929 - protein, 3292 aa, Artificial Sequence
  derived and/or modified protein sequence (wt) from DENV-1__FJ687429__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWIDVVLEHGSCITTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2930 - protein, 3292 aa, Artificial Sequence
  derived and/or modified protein sequence (wt) from DENV-1__FJ850068__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLAGASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2931 - protein, 3292 aa, Artificial Sequence
  derived and/or modified protein sequence (wt) from DENV-1__FJ687430__SS-prME
SVTMLLMLMPTALAFHLTTRGGEPHMIVSKQERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTILVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDKMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHALEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHASMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQTAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2932 - protein, 3292 aa, Artificial Sequence
  derived and/or modified protein sequence (wt) from DENV-1__FJ687432__SS-prME
SVTMLLMLMPTALAFHLTTRGGEPHMIVSKQERGKSLLFKTSTGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTILVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHALEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHASMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQTAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2933 - protein, 3292 aa, Artificial Sequence
  derived and/or modified protein sequence (wt) from DENV-1__JQ922547__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGAPWVDVVLEHGSCVTTMAKNKPTLDIELLKTEVTNPAVLRKLCIEAKISNTTTDSRCPTQGEATLVEEQDANCVCRRTFVDRGWGNGCGLFGKGSLITCAKFKCVTKLEGKIVQYENLKYSVIVTVHTGDQHQVGNETTTHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMLEATARGARRMAILGDTAWDFGSIGGVFTSMGKLVHQVFGTAYGVLFSGVSWTMKIGIGILLTWLGLNSRNTSLSMMCIAVGMVTLYLGVMVQADSGCVINWKGRELLCGTGIFVTNEVHTWTDPYKFQADPSNRLSPIIGKACVIRVCGIRSATRLENIMWKQISNELNHILLENDMKFTVVVGDVSGILAQGEKMIRPQPMEHKYSWKSWGKAKIIGADVQNTTFIIDGPNTPECPDNQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDFCEGTTVVVDEHCGNRGPSLRTTTVTGKIIHEWCCRSCTLPPLRFKGEDGCWYGMEIRPVKDKEENLVKSMVSAGSGEVDSFSLGLLCISIMIEEVMRSRWSKKMLMVGTLAVFLLLIMGQLTWSDLIRLCIMVGANASDRMGMGTTYLALMATFKMRPMFAVGLLFPKLTSREVLLLTIGLSLVASVELPSSLEELGDGLAKGIMMLKLLTDFQSHQLWATLLSLTFIKTTFSLHYAWKTMAMVLSIVSLFPLCLSTTSQKTTWLPVLLGSLGCKPLPMFLITENKIWGRKSWPLNEGIMAVGIVSILLSSLLKNDVPLAGPLIAGGMLVACYVISGSSADLSLEKAAEVSWEEEAEHSGASHNILVEVQDDGTRKIKDEERDDTLTILLKATLLAVSGVYPMSIPATLFVWYFWQKKNQRSGVGLITPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGRNPKNVQTAPGTFKTPEGEVGAIPLDFKPGTSGSPIVNREGKIVGLYGNGVVTTSGTYVSAIARAKASQEGPLPEIEDEVFRKRNLTIMDLHPGSGKTRRYLPAIVREAIKRKLRTLILAPTRVVASEMAEALKGVPIRYQTTAVKSEHTGKEIVDLMCHATFTMRLLSPVRVPNYNMIIMDEAHFTDPASIAARGYISTRVGMGEAAAIFMTATPTGSVEAFPQSNAIIQDEERDIPERSWNSGYDWITDFPGKTVWFVPSIKSGNDIANCLKKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPSNNDEDHAHWTEAKMLLDNINTPEGIIPALFEPEREKSAAIDGEYRLRGEARKTFVELMRRGDLPVWLSYKVASEGFQYSDRRWCFDGERNNQVLEENKDVEIWTKEGERKKLRTCWLDARTYSDPLALREFKEFAAGRRSVSGDLILEIGKLPQHLTQKAQKALDNLVMLHNSEQGGKAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNKMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLATSIFKLTYQNKVVRVQRPAKNGTVMDAISRRDQRGSGQVGTYGLNTFLHKEAQLIRQMEFEGIFLPSELETPNLAGRVLDWLEQYGVERLKRMAISGDDCVVKPIDDRFATALTALNDMGKVRKDIPQWEPSKGWGDWQQVPFCSHHFHQLIMKDVREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2934 - protein, 3292 aa, Artificial Sequence
  derived and/or modified protein sequence (wt) from DENV-1__EU482567__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLILVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSAGKLVHQVFGAAYGVLFSGVSWTMKIGIGILLTWLGLNSRSTSLSMTCIAVGMVTLYLGVVVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNATFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFINTTLSLDYAWRTMAMVLSIISLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAREGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWNLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDERFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2935 - protein, 3292 aa, Artificial Sequence
  derived and/or modified protein sequence (wt) from DENV-1__FJ390378__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGYVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2936 - protein, 3292 aa, Artificial Sequence
  derived and/or modified protein sequence (wt) from DENV-1__FJ205872__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTAFFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAALTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGYVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2937 - protein, 3292 aa, Artificial Sequence
  derived and/or modified protein sequence (wt) from DENV-1__FJ205873__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKVVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2938 - protein, 3292 aa, Artificial Sequence
  derived and/or modified protein sequence (wt) from DENV-1__FJ390379__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGRKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2939 - protein, 3292 aa, Artificial Sequence
  derived and/or modified protein sequence (wt) from DENV-1__FJ390380__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFELCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLVVFFLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATFFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2940 - protein, 3292 aa, Artificial Sequence
  derived and/or modified protein sequence (wt) from DENV-1__FJ205874__SS-prME
SVTMLLMLLPTVLAFHLTTRGGEPHMIVGKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPLSTQDEKGVTQNGRLITANPIVTDKEKPVNIETEPPFGESYIIVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGVRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWRLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCLSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAVALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWSSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMKRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVMLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHVTMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLGIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWDFLSRNKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETTNLAERVLDWLEKHGVERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2941 - protein, 3292 aa, Artificial Sequence
  derived and/or modified protein sequence (wt) from DENV-1__FJ205875__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSKKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWSTGEEVQVIAVEPGKNPKNVQTTPGTFKTPEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWLVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGDGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGTERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2942 - protein, 3292 aa, Artificial Sequence
  derived and/or modified protein sequence (wt) from DENV-1__FJ410173__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATFFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2943 - protein, 3292 aa, Artificial Sequence
  derived and/or modified protein sequence (wt) from DENV-1__FJ410174__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTIAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGITYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAALAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEAEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2944 - protein, 3292 aa, Artificial Sequence
  derived and/or modified protein sequence (wt) from DENV-1__FJ410175__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2945 - protein, 3292 aa, Artificial Sequence
  derived and/or modified protein sequence (wt) from DENV-1__FJ562105__SS-prME
SVTMLLMLLPTVLAFHLTTRGGEPHMIVGKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPLSTQDEKGVTQNGRLITANPIVTDKEKPVNIETEPPFGESYIIVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGVRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCLSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAVALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVMLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHVTMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLGGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLGIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWDFLSRNKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETTNLAERVLDWLEKHGVERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2946 - protein, 3292 aa, Artificial Sequence
  derived and/or modified protein sequence (wt) from DENV-1__FJ562106__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIMVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKNSKAVHADMGYWIESEKNETWKLARASFIEVKTCIWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTFSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPCELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTTRATWATNIQVAINQVRRLIGNENYLDYMTSMKRFKNESDPEGALW

SEQ ID NO: 2947 - protein, 3292 aa, Artificial Sequence
  derived and/or modified protein sequence (wt) from DENV-1__FJ410179__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2948 - protein, 3292 aa, Artificial Sequence
  derived and/or modified protein sequence (wt) from DENV-1__FJ410181__SS-prME
SVTMLLMLLPTALAFHLTTRGGEPHMIVSKQERGKSLLFKTSVGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVYRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2949 - protein, 3292 aa, Artificial Sequence
  derived and/or modified protein sequence (wt) from DENV-1__FJ547086__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIMVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCAINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQQGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPCELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESNPEGALW

SEQ ID NO: 2950 - protein, 3292 aa, Artificial Sequence
  derived and/or modified protein sequence (wt) from DENV-1__FJ410183__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTAFFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEMDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFIILTVAANEMGLLETTKKDLGIGHVAAESQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2951 - protein, 3292 aa, Artificial Sequence
  derived and/or modified protein sequence (wt) from DENV-1__FJ410184__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEREENLVKSMVSAGLGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSLGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGAWNTGEEVQVIAVEPGKNPKNVQTTPGTFKTPEGEVGAIALDFKPGTSGSPIVNREGKIVGLYGNGVVTTSGTYVSAIAQAKTSQEGSLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGYVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2952 - protein, 3292 aa, Artificial Sequence
  derived and/or modified protein sequence (wt) from DENV-1__FJ410185__SS-prME
SVTMLLMLLPTALAFHLTTRGGEPHMIVSKQERGKSLLFKTSVGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2953 - protein, 3292 aa, Artificial Sequence
  derived and/or modified protein sequence (wt) from DENV-1__FJ547087__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIMVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQDGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTIRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPCELETPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2954 - protein, 3292 aa, Artificial Sequence
  derived and/or modified protein sequence (wt) from DENV-1__FJ410186__SS-prME
SVTMLLMLLPTALAFHLTTRGGEPHMIVSKQERGKSLLFKTSAGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIIVGAGEKALKLSWFKKGSSIGKMFEATARGARRMAILGDTAWDFGSIGGVFTSVGKLVHQVFGTAYGVLFSGVSWTMKIGIGILLTWLGLNSRSASLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQARATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSADPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMISMKRFKNESDPEGALW

SEQ ID NO: 2955 - protein, 3292 aa, Artificial Sequence
  derived and/or modified protein sequence (wt) from DENV-1__FJ410187__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2956 - protein, 3292 aa, Artificial Sequence
  derived and/or modified protein sequence (wt) from DENV-1__FJ478457__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQHENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGMFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDASGILAQGKKMIRPQPMEHKYSWKSWGKAKIIGADIQNTTFIIDGPDTPECSDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVIVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNMLVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQVMEVTAKWLWGFLSRNKKPRICTREEFTRKVRSNAAIGAVFVDENQWNSAKEAVEDEKFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPIDDRFATALIALNDMGKVRKDIPQWEPSKGWNEWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2957 - protein, 3292 aa, Artificial Sequence
  derived and/or modified protein sequence (wt) from DENV-1__FJ410188__SS-prME
SVTMLLMLLPTVLAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQHENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGMFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDASGILAQGKKMIRPQPMEHKYSWKSWGKAKIIGADIQNTTFIIDGPDTPECSDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVIVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTMAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNMLVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQVMEVTAKWLWGFLSRNKKPRICTREEFTRKVRSNAAIGAVFVDENQWNSAKEAVEDEKFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPIDDRFATALIALNDMGKVRKDIPQWEPSKGWNEWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2958 - protein, 3292 aa, Artificial Sequence
  derived and/or modified protein sequence (wt) from DENV-1__FJ478458__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAILRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIASLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2959 - protein, 3292 aa, Artificial Sequence
  derived and/or modified protein sequence (wt) from DENV-1__FJ410190__SS-prME
SVTMLLMLLPTALAFHLTTRGGEPHMIVSKQERGKSLLFKTSVGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKTSQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGHVAAENQQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2960 - protein, 3292 aa, Artificial Sequence
  derived and/or modified protein sequence (wt) from DENV-1__EU482591__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHSILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2961 - protein, 3292 aa, Artificial Sequence
  derived and/or modified protein sequence (wt) from DENV-1__EU482592__SS-prME
SVTMLLMLLPTALAFHLTTRGGEPHMIVSKQERGKSLLFKTSAGINMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDSNFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHRYSWKSWGKAKIIGADIQNSTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWRTMAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKTSQEGPLPEIEEEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMANVEPHWIAASIILEFFLMVLLIPEPDRQRTPQDNQLAYVVIGLLFMILTVAANEMGLLETTKKDLGIGYVAAENQHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKNEHKSTWYYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLNWLEKHGTERLKRMAISGDDCVVKPVDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2962 - protein, 3292 aa, Artificial Sequence
  derived and/or modified protein sequence (wt) from DENV-1__EU482609__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQARASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFSPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2963 - protein, 3292 aa, Artificial Sequence
  derived and/or modified protein sequence (wt) from DENV-1__EU482610__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWVLRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2964 - protein, 3292 aa, Artificial Sequence
  derived and/or modified protein sequence (wt) from DENV-1__EU482611__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2965 - protein, 3292 aa, Artificial Sequence
  derived and/or modified protein sequence (wt) from DENV-1__FJ639735__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIVMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2966 - protein, 3292 aa, Artificial Sequence
  derived and/or modified protein sequence (wt) from DENV-1__FJ639740__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFATQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2967 - protein, 3292 aa, Artificial Sequence
  derived and/or modified protein sequence (wt) from DENV-1__FJ639741__SS-prME
SVTILLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGTSTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLAKASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGLGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVKLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWNLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2968 - protein, 3292 aa, Artificial Sequence
  derived and/or modified protein sequence (wt) from DENV-1__FJ639743__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVRYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKVIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTSEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGRTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMSPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIRNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2969 - protein, 3292 aa, Artificial Sequence
  derived and/or modified protein sequence (wt) from DENV-1__FJ639794__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIVVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNLGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLVMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2970 - protein, 3292 aa, Artificial Sequence
  derived and/or modified protein sequence (wt) from DENV-1__FJ639796__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2971 - protein, 3292 aa, Artificial Sequence
  derived and/or modified protein sequence (wt) from DENV-1__FJ639797__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2972 - protein, 3292 aa, Artificial Sequence
  derived and/or modified protein sequence (wt) from DENV-1__FJ639802__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYRFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2973 - protein, 3292 aa, Artificial Sequence
  derived and/or modified protein sequence (wt) from DENV-1__JN819410__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTLVDRGWGNGCGLFGKGNLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2974 - protein, 3292 aa, Artificial Sequence
  derived and/or modified protein sequence (wt) from DENV-1__FJ639806__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLKKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2975 - protein, 3292 aa, Artificial Sequence
  derived and/or modified protein sequence (wt) from DENV-1__JN819411__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIVGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKLTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFSPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2976 - protein, 3292 aa, Artificial Sequence
  derived and/or modified protein sequence (wt) from DENV-1__FJ639812__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMMLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLLLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2977 - protein, 3292 aa, Artificial Sequence
  derived and/or modified protein sequence (wt) from DENV-1__FJ639813__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVMNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSFSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPMPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNSAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFSPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2978 - protein, 3292 aa, Artificial Sequence
  derived and/or modified protein sequence (wt) from DENV-1__JN819412__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLLLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2979 - protein, 3292 aa, Artificial Sequence
  derived and/or modified protein sequence (wt) from DENV-1__FJ810415__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGVIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLNWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2980 - protein, 3292 aa, Artificial Sequence
  derived and/or modified protein sequence (wt) from DENV-1__FJ639814__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2981 - protein, 3292 aa, Artificial Sequence
  derived and/or modified protein sequence (wt) from DENV-1__FJ639815__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMLLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2982 - protein, 3292 aa, Artificial Sequence
  derived and/or modified protein sequence (wt) from DENV-1__FJ639818__SS-prME
SVTMLLMLLPTALAFHLTTRGGEPHMIVSKQERGKSLLFKTSAGVNMCTLIAMDLGELCEDTMTYKCPRITEAEPDDVDCWCNTTDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMEKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2983 - protein, 3292 aa, Artificial Sequence
  derived and/or modified protein sequence (wt) from DENV-1__FJ639819__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDNFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWACVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2984 - protein, 3292 aa, Artificial Sequence
  derived and/or modified protein sequence (wt) from DENV-1__FJ639820__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLAMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2985 - protein, 3292 aa, Artificial Sequence
  derived and/or modified protein sequence (wt) from DENV-1__FJ639821__SS-prME
SATMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVRYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYYTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDNFSLGILCVSIMIEEVMRSRWSRKMLMTGTLAVFLLLIMGQLTWNDLIRLCIMVGANASDGMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLDKAAEVSWEQEAEHSGASHNISVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWACVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDVKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTNHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2986 - protein, 3292 aa, Artificial Sequence
  derived and/or modified protein sequence (wt) from DENV-1__FJ639824__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLVAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2987 - protein, 3292 aa, Artificial Sequence
  derived and/or modified protein sequence (wt) from DENV-1__JN819425__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAVKISWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2988 - protein, 3292 aa, Artificial Sequence
  derived and/or modified protein sequence (wt) from DENV-1__FJ850099__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLSSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2989 - protein, 3292 aa, Artificial Sequence
  derived and/or modified protein sequence (wt) from DENV-1__FJ850100__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLMASMELPNSLEELGDGLAMGIMMLKLLTEFQPHQLWTTLLSLTFVKTTLSLDYAWKTTAMILSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSTLLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2990 - protein, 3292 aa, Artificial Sequence
  derived and/or modified protein sequence (wt) from DENV-1__FJ882579__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLLLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2991 - protein, 3292 aa, Artificial Sequence
  derived and/or modified protein sequence (wt) from DENV-1__JN819414__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAYAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLLLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTGGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNTAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2992 - protein, 3292 aa, Artificial Sequence
  derived and/or modified protein sequence (wt) from DENV-1__FJ873810__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2993 - protein, 3292 aa, Artificial Sequence
  derived and/or modified protein sequence (wt) from DENV-1__FJ850103__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVRESIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVKLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2994 - protein, 3292 aa, Artificial Sequence
  derived and/or modified protein sequence (wt) from DENV-1__FJ850104__SS-prME
SVTMLLMLLPTALAFHLTTRGGEPHMIVSKQERGKSLLFKTSAGVNMCTLIAMDLGELCEDTMTYKCPRITEAEPDDVDCWCNVTDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2995 - protein, 3292 aa, Artificial Sequence
  derived and/or modified protein sequence (wt) from DENV-1__JN819405__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLMASMELPNSLEELGDGLAMGIMMLKLLTEFQPHQLWTTLLSLTFVKTTLSLDYAWKTTAMILSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSETTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKNFTEVKGYTSGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2996 - protein, 3292 aa, Artificial Sequence
  derived and/or modified protein sequence (wt) from DENV-1__GQ199877__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPSSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2997 - protein, 3292 aa, Artificial Sequence
  derived and/or modified protein sequence (wt) from DENV-1__GU056029__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILVQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTALSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 2998 - protein, 3292 aa, Artificial Sequence
  derived and/or modified protein sequence (wt) from DENV-1__GU056030__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVRYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYYTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDNFSLGILCVSIMIEEVMRSRWSRKMLMTGTLAVFLLLIMGQLTWNDLIRLCIMVGANASDGMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLDKAAEVSWEQEAEHSGASHNISVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWACVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDVKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTNHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVTVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2999 - protein, 3292 aa, Artificial Sequence
  derived and/or modified protein sequence (wt) from DENV-1__GU056031__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPSTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYSDYMTSMKRFKNESDPEGALW

SEQ ID NO: 3000 - protein, 3292 aa, Artificial Sequence
  derived and/or modified protein sequence (wt) from DENV-1__GU056032__SS-prME
SVAMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAVGIVSMLLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDTEGALW

SEQ ID NO: 3001 - protein, 3292 aa, Artificial Sequence
  derived and/or modified protein sequence (wt) from DENV-1__GU056033__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLAKASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRISQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAESHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKTEFNTYKRSGIMEVDRSEAKEGLKRGETTKHAVSRGTAKLRWFVERNLVKPEGKVIDLGCGRGGWSYYCAGLKKVTEVKGYTKGGLGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVKLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWNLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3002 - protein, 3292 aa, Artificial Sequence
  derived and/or modified protein sequence (wt) from DENV-1__GU131833__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQNGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFINEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMASMKRFKNESDPEGALW

SEQ ID NO: 3003 - protein, 3292 aa, Artificial Sequence
  derived and/or modified protein sequence (wt) from DENV-1__GU131834__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKTLKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFFITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3004 - protein, 3292 aa, Artificial Sequence
  derived and/or modified protein sequence (wt) from DENV-1__GU131835__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWVLRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLAEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAMKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVMLFFLSGKGLGKTSIGLLCVTASSALLWMASVEPHWIAASIVLEFFLMVLLIPEPDRQRTPQDNQLAYVVIGLLFMILTVAANEMGLLETTKKDLGIGHAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPTVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATSLTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDLEGALW

SEQ ID NO: 3005 - protein, 3292 aa, Artificial Sequence
  derived and/or modified protein sequence (wt) from DENV-1__GU131836__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILVQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLSRASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVPNLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPGHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3006 - protein, 3292 aa, Artificial Sequence
  derived and/or modified protein sequence (wt) from DENV-1__GU131837__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3007 - protein, 3292 aa, Artificial Sequence
  derived and/or modified protein sequence (wt) from DENV-1__JN819415__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEEKDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKRDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3008 - protein, 3292 aa, Artificial Sequence
  derived and/or modified protein sequence (wt) from DENV-1__GU131838__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKTAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3009 - protein, 3292 aa, Artificial Sequence
  derived and/or modified protein sequence (wt) from DENV-1__GU131839__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKTVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILVQGKKMIRPQPMEHKYSWKSWGKAKIIGADTQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTALSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDNGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTSAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFREKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNVYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDSEGALW

SEQ ID NO: 3010 - protein, 3292 aa, Artificial Sequence
  derived and/or modified protein sequence (wt) from DENV-1__GU131841__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIAFFLAYAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3011 - protein, 3292 aa, Artificial Sequence
  derived and/or modified protein sequence (wt) from DENV-1__GQ868601__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTRLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRRMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTTLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKQGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 3012 - protein, 3292 aa, Artificial Sequence
  derived and/or modified protein sequence (wt) from DENV-1__EU660390__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVIVGDVAGILGQGRKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLVAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3013 - protein, 3292 aa, Artificial Sequence
  derived and/or modified protein sequence (wt) from DENV-1__EU660391__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQDGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3014 - protein, 3292 aa, Artificial Sequence
  derived and/or modified protein sequence (wt) from DENV-1__EU660393__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGITQSGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYRRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3015 - protein, 3292 aa, Artificial Sequence
  derived and/or modified protein sequence (wt) from DENV-1__EU660401__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3016 - protein, 3292 aa, Artificial Sequence
  derived and/or modified protein sequence (wt) from DENV-1__FJ373305__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTVSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3017 - protein, 3292 aa, Artificial Sequence
  derived and/or modified protein sequence (wt) from DENV-1__EU660402__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGIDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANAYDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVMLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3018 - protein, 3292 aa, Artificial Sequence
  derived and/or modified protein sequence (wt) from DENV-1__EU660403__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3019 - protein, 3292 aa, Artificial Sequence
  derived and/or modified protein sequence (wt) from DENV-1__EU660397__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3020 - protein, 3292 aa, Artificial Sequence
  derived and/or modified protein sequence (wt) from DENV-1__EU687247__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLNWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3021 - protein, 3292 aa, Artificial Sequence
  derived and/or modified protein sequence (wt) from DENV-1__EU660412__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMISMKRFKNESDPEGALW

SEQ ID NO: 3022 - protein, 3292 aa, Artificial Sequence
  derived and/or modified protein sequence (wt) from DENV-1__EU660418__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3023 - protein, 3292 aa, Artificial Sequence
  derived and/or modified protein sequence (wt) from DENV-1__EU677151__SS-prME
SVTMLLMLIPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGASLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMVAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3024 - protein, 3292 aa, Artificial Sequence
  derived and/or modified protein sequence (wt) from DENV-1__EU677152__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3025 - protein, 3292 aa, Artificial Sequence
  derived and/or modified protein sequence (wt) from DENV-1__EU677155__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAGSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3026 - protein, 3292 aa, Artificial Sequence
  derived and/or modified protein sequence (wt) from DENV-1__EU677157__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTLVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3027 - protein, 3292 aa, Artificial Sequence
  derived and/or modified protein sequence (wt) from DENV-1__EU677158__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFVLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3028 - protein, 3292 aa, Artificial Sequence
  derived and/or modified protein sequence (wt) from DENV-1__EU677159__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPISIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMISMKRFKNESDPEGALW

SEQ ID NO: 3029 - protein, 3292 aa, Artificial Sequence
  derived and/or modified protein sequence (wt) from DENV-1__EU677160__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLVLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSLVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3030 - protein, 3292 aa, Artificial Sequence
  derived and/or modified protein sequence (wt) from DENV-1__EU677162__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGRMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3031 - protein, 3292 aa, Artificial Sequence
  derived and/or modified protein sequence (wt) from DENV-1__EU677164__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRIAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKNYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVLFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTTLLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3032 - protein, 3292 aa, Artificial Sequence
  derived and/or modified protein sequence (wt) from DENV-1__EU677165__SS-prME
SVTMLLMLMPTALAFHLTTRGGEPHMIVSKQERGKSLLFKTSAGVNMCTLIAMDLGELCEDTITYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLATPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLARNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3033 - protein, 3292 aa, Artificial Sequence
  derived and/or modified protein sequence (wt) from DENV-1__EU677140__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3034 - protein, 3292 aa, Artificial Sequence
  derived and/or modified protein sequence (wt) from DENV-1__EU677166__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3035 - protein, 3292 aa, Artificial Sequence
  derived and/or modified protein sequence (wt) from DENV-1__EU677170__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWMKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPILAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3036 - protein, 3292 aa, Artificial Sequence
  derived and/or modified protein sequence (wt) from DENV-1__EU677171__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3037 - protein, 3292 aa, Artificial Sequence
  derived and/or modified protein sequence (wt) from DENV-1__EU677172__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLTMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3038 - protein, 3292 aa, Artificial Sequence
  derived and/or modified protein sequence (wt) from DENV-1__EU677173__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNAGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3039 - protein, 3292 aa, Artificial Sequence
  derived and/or modified protein sequence (wt) from DENV-1__EU726779__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3040 - protein, 3292 aa, Artificial Sequence
  derived and/or modified protein sequence (wt) from DENV-1__EU677176__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTKRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESERIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNDSDPEGALW

SEQ ID NO: 3041 - protein, 3292 aa, Artificial Sequence
  derived and/or modified protein sequence (wt) from DENV-1__EU726780__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWVTLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLISEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3042 - protein, 3292 aa, Artificial Sequence
  derived and/or modified protein sequence (wt) from DENV-1__EU726781__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIVVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKNYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVLFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3043 - protein, 3292 aa, Artificial Sequence
  derived and/or modified protein sequence (wt) from DENV-1__EU726782__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3044 - protein, 3292 aa, Artificial Sequence
  derived and/or modified protein sequence (wt) from DENV-1__EU677178__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANTSDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3045 - protein, 3292 aa, Artificial Sequence
  derived and/or modified protein sequence (wt) from DENV-1__EU687251__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3046 - protein, 3292 aa, Artificial Sequence
  derived and/or modified protein sequence (wt) from DENV-1__FJ024427__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTGYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGADAPCKIPFSTQDEKGITQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFNRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3047 - protein, 3292 aa, Artificial Sequence
  derived and/or modified protein sequence (wt) from DENV-1__FJ024428__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3048 - protein, 3292 aa, Artificial Sequence
  derived and/or modified protein sequence (wt) from DENV-1__FJ024429__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLMTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQIAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNRERKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3049 - protein, 3292 aa, Artificial Sequence
  derived and/or modified protein sequence (wt) from DENV-1__FJ024430__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMLLIAENKIWGRRSWPLNEGIMAVGIVSILLSSLLKNDVPLAGPLIAGGMLIACYVISGSSAALSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPTKNGTVMDVISRRDQRGSGQVGTYGLNTFTNMEAQLIRQMESEGIFSPSELETPNLAERVLDWLEKYGVERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3050 - protein, 3292 aa, Artificial Sequence
  derived and/or modified protein sequence (wt) from DENV-1__FJ024433__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASISQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWNLRETACLGKSYAQMWQLMYFHRRDLRLAANAICSAVPVDWIPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3051 - protein, 3292 aa, Artificial Sequence
  derived and/or modified protein sequence (wt) from DENV-1__FJ024434__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREYKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLAAGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMISMKRFKNESDPEGALW

SEQ ID NO: 3052 - protein, 3292 aa, Artificial Sequence
  derived and/or modified protein sequence (wt) from DENV-1__FJ024435__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIYEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3053 - protein, 3292 aa, Artificial Sequence
  derived and/or modified protein sequence (wt) from DENV-1__FJ024436__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEYGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWDEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRKSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3054 - protein, 3292 aa, Artificial Sequence
  derived and/or modified protein sequence (wt) from DENV-1__FJ024472__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAVGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVIFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3055 - protein, 3292 aa, Artificial Sequence
  derived and/or modified protein sequence (wt) from DENV-1__FJ024439__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRQAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3056 - protein, 3292 aa, Artificial Sequence
  derived and/or modified protein sequence (wt) from DENV-1__FJ024441__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWRQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYITIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3057 - protein, 3292 aa, Artificial Sequence
  derived and/or modified protein sequence (wt) from DENV-1__FJ024442__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGRIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNLGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3058 - protein, 3292 aa, Artificial Sequence
  derived and/or modified protein sequence (wt) from DENV-1__FJ373296__SS-prME
SVTMLLMLMPIALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3059 - protein, 3292 aa, Artificial Sequence
  derived and/or modified protein sequence (wt) from DENV-1__FJ182018__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAIIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3060 - protein, 3292 aa, Artificial Sequence
  derived and/or modified protein sequence (wt) from DENV-1__FJ410287__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITSQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3061 - protein, 3292 aa, Artificial Sequence
  derived and/or modified protein sequence (wt) from DENV-1__FJ432719__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTAEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3062 - protein, 3292 aa, Artificial Sequence
  derived and/or modified protein sequence (wt) from DENV-1__FJ182020__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3063 - protein, 3292 aa, Artificial Sequence
  derived and/or modified protein sequence (wt) from DENV-1__FJ182022__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3064 - protein, 3292 aa, Artificial Sequence
  derived and/or modified protein sequence (wt) from DENV-1__FJ024447__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKVVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3065 - protein, 3292 aa, Artificial Sequence
  derived and/or modified protein sequence (wt) from DENV-1__FJ182025__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVIASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPTKNGTVMDVISRRDQRGSGQVGTYGLNTFTNMEAQLIRQMESEGIFSPSELETPNLAERVLDWLEKYGVERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3066 - protein, 3292 aa, Artificial Sequence
  derived and/or modified protein sequence (wt) from DENV-1__FJ373297__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTNRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNDSDPEGALW

SEQ ID NO: 3067 - protein, 3292 aa, Artificial Sequence
  derived and/or modified protein sequence (wt) from DENV-1__FJ024448__SS-prME
SVTMLLMLMPTALAFHLTTRGGEPHMIVSKQERGKSLLFKTSAGVNMCTLIAMDLGELCEDTITYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAASGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3068 - protein, 3292 aa, Artificial Sequence
  derived and/or modified protein sequence (wt) from DENV-1__FJ182026__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQNEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNAGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3069 - protein, 3292 aa, Artificial Sequence
  derived and/or modified protein sequence (wt) from DENV-1__FJ182027__SS-prME
SVTMLLMLMPTALAFHLTTRGGEPHMIVSKQERGKSLLFKTSAGVNMCTLIAMDLGELCEDTITYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3070 - protein, 3292 aa, Artificial Sequence
  derived and/or modified protein sequence (wt) from DENV-1__FJ024449__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYDVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLKKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3071 - protein, 3292 aa, Artificial Sequence
  derived and/or modified protein sequence (wt) from DENV-1__FJ390383__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDEPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3072 - protein, 3292 aa, Artificial Sequence
  derived and/or modified protein sequence (wt) from DENV-1__FJ182033__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGLGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3073 - protein, 3292 aa, Artificial Sequence
  derived and/or modified protein sequence (wt) from DENV-1__FJ182034__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3074 - protein, 3292 aa, Artificial Sequence
  derived and/or modified protein sequence (wt) from DENV-1__FJ182036__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLATPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPMSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3075 - protein, 3292 aa, Artificial Sequence
  derived and/or modified protein sequence (wt) from DENV-1__FJ205876__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFNRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3076 - protein, 3292 aa, Artificial Sequence
  derived and/or modified protein sequence (wt) from DENV-1__FJ024455__SS-prME
SVTMLLMLMPTALAFHLTTRGGEPHMIVSKQERGKSLLFKTSVGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPPPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3077 - protein, 3292 aa, Artificial Sequence
  derived and/or modified protein sequence (wt) from DENV-1__FJ024456__SS-prME
SVTMLLMLMPTALAFHLTTRGGEPHMIVTKQERGKSLLFKTSAGVNMCILIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGMEEPIPMATNGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3078 - protein, 3292 aa, Artificial Sequence
  derived and/or modified protein sequence (wt) from DENV-1__FJ024457__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPILAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3079 - protein, 3292 aa, Artificial Sequence
  derived and/or modified protein sequence (wt) from DENV-1__FJ205881__SS-prME
SVTMLLLLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKTSQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3080 - protein, 3292 aa, Artificial Sequence
  derived and/or modified protein sequence (wt) from DENV-1__FJ205882__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWDEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWKVEDHGFGIFPTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRKSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3081 - protein, 3292 aa, Artificial Sequence
  derived and/or modified protein sequence (wt) from DENV-1__FJ390388__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLMTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNRERKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3082 - protein, 3292 aa, Artificial Sequence
  derived and/or modified protein sequence (wt) from DENV-1__FJ024464__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGVRRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPMSQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3083 - protein, 3292 aa, Artificial Sequence
  derived and/or modified protein sequence (wt) from DENV-1__FJ410191__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKGEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKRDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLVLCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNIEAQLIRQMESEEIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3084 - protein, 3292 aa, Artificial Sequence
  derived and/or modified protein sequence (wt) from DENV-1__FJ432723__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALIATFKMRPMFAVGLLFRRLTSREVLLLTIGLSLVASVELPNSLEELGDGLAMGIMILKLLTDFQSHQLWATLLSFTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPGELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3085 - protein, 3292 aa, Artificial Sequence
  derived and/or modified protein sequence (wt) from DENV-1__FJ410192__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQSPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3086 - protein, 3292 aa, Artificial Sequence
  derived and/or modified protein sequence (wt) from DENV-1__FJ410194__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLPSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEPRITDIMEPEHALLAKSIFKLTYQNKVVRVQSPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFWSHHFHQLIMKDGREIVVPCRNQDELVGRARVSQGAGWSLRETACLAKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3087 - protein, 3292 aa, Artificial Sequence
  derived and/or modified protein sequence (wt) from DENV-1__FJ432725__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAGVTGGVTLVFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLAKGWPISKMDIGVPLLALGCYSQVNPLTLTAPVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGPRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLGHRERELHKQGKCATCVSNMMGKREKKLGEFGKPKGSRPIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISSRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3088 - protein, 3292 aa, Artificial Sequence
  derived and/or modified protein sequence (wt) from DENV-1__FJ432729__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMLLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3089 - protein, 3292 aa, Artificial Sequence
  derived and/or modified protein sequence (wt) from DENV-1__FJ432730__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGMTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3090 - protein, 3292 aa, Artificial Sequence
  derived and/or modified protein sequence (wt) from DENV-1__FJ432732__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYITIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGIFAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3091 - protein, 3292 aa, Artificial Sequence
  derived and/or modified protein sequence (wt) from DENV-1__FJ432733__SS-prME
SVTMLLMLMPTALAFHLTTRGGEPHMIVTKQERGKSLLFKTSAGVNMCTLIAMDLGELCEDTMTYKCPRITEVEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMLLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3092 - protein, 3292 aa, Artificial Sequence
  derived and/or modified protein sequence (wt) from DENV-1__FJ410196__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPFSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRGISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3093 - protein, 3292 aa, Artificial Sequence
  derived and/or modified protein sequence (wt) from DENV-1__FJ432734__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWVLRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGMFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNETDPEGALW

SEQ ID NO: 3094 - protein, 3292 aa, Artificial Sequence
  derived and/or modified protein sequence (wt) from DENV-1__FJ432735__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3095 - protein, 3292 aa, Artificial Sequence
  derived and/or modified protein sequence (wt) from DENV-1__FJ432736__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYLTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGPGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGIYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3096 - protein, 3292 aa, Artificial Sequence
  derived and/or modified protein sequence (wt) from DENV-1__FJ410198__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3097 - protein, 3292 aa, Artificial Sequence
  derived and/or modified protein sequence (wt) from DENV-1__FJ410199__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKNYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVLFLLIMGQLTWSDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRKYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3098 - protein, 3292 aa, Artificial Sequence
  derived and/or modified protein sequence (wt) from DENV-1__FJ432739__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGILAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3099 - protein, 3292 aa, Artificial Sequence
  derived and/or modified protein sequence (wt) from DENV-1__FJ410201__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLNYMTSMKRFKNESDPEGALW

SEQ ID NO: 3100 - protein, 3292 aa, Artificial Sequence
  derived and/or modified protein sequence (wt) from DENV-1__FJ410203__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3101 - protein, 3292 aa, Artificial Sequence
  derived and/or modified protein sequence (wt) from DENV-1__FJ410204__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVYTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGETKKLRHRWPDARQYSDPLGLREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3102 - protein, 3292 aa, Artificial Sequence
  derived and/or modified protein sequence (wt) from DENV-1__FJ432742__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3103 - protein, 3292 aa, Artificial Sequence
  derived and/or modified protein sequence (wt) from DENV-1__FJ410205__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3104 - protein, 3292 aa, Artificial Sequence
  derived and/or modified protein sequence (wt) from DENV-1__FJ410207__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFMVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKLVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENRIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3105 - protein, 3292 aa, Artificial Sequence
  derived and/or modified protein sequence (wt) from DENV-1__FJ432744__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGILAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKRRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3106 - protein, 3292 aa, Artificial Sequence
  derived and/or modified protein sequence (wt) from DENV-1__FJ547060__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLVRQMESEGIFSPCELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3107 - protein, 3292 aa, Artificial Sequence
  derived and/or modified protein sequence (wt) from DENV-1__FJ432745__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3108 - protein, 3292 aa, Artificial Sequence
  derived and/or modified protein sequence (wt) from DENV-1__FJ432746__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNYILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDTKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFVRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3109 - protein, 3292 aa, Artificial Sequence
  derived and/or modified protein sequence (wt) from DENV-1__FJ432748__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKVPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3110 - protein, 3292 aa, Artificial Sequence
  derived and/or modified protein sequence (wt) from DENV-1__FJ432749__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGVLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGAFW

SEQ ID NO: 3111 - protein, 3292 aa, Artificial Sequence
  derived and/or modified protein sequence (wt) from DENV-1__FJ410212__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGALLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIVTPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3112 - protein, 3292 aa, Artificial Sequence
  derived and/or modified protein sequence (wt) from DENV-1__FJ461307__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMISMKRFKNESEPEGALW

SEQ ID NO: 3113 - protein, 3292 aa, Artificial Sequence
  derived and/or modified protein sequence (wt) from DENV-1__FJ410213__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKDDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3114 - protein, 3292 aa, Artificial Sequence
  derived and/or modified protein sequence (wt) from DENV-1__FJ461308__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESCIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3115 - protein, 3292 aa, Artificial Sequence
  derived and/or modified protein sequence (wt) from DENV-1__FJ461310__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQRKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAIEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3116 - protein, 3292 aa, Artificial Sequence
  derived and/or modified protein sequence (wt) from DENV-1__FJ906728__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALILDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGPFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLLRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNTGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILAVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3117 - protein, 3292 aa, Artificial Sequence
  derived and/or modified protein sequence (wt) from DENV-1__FJ461313__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRSTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALNWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3118 - protein, 3292 aa, Artificial Sequence
  derived and/or modified protein sequence (wt) from DENV-1__FJ547063__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLQRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3119 - protein, 3292 aa, Artificial Sequence
  derived and/or modified protein sequence (wt) from DENV-1__FJ410218__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIVENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3120 - protein, 3292 aa, Artificial Sequence
  derived and/or modified protein sequence (wt) from DENV-1__FJ461316__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEYKYSWKSWGKAKIMGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3121 - protein, 3292 aa, Artificial Sequence
  derived and/or modified protein sequence (wt) from DENV-1__FJ410220__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIVFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3122 - protein, 3292 aa, Artificial Sequence
  derived and/or modified protein sequence (wt) from DENV-1__JF937649__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3123 - protein, 3292 aa, Artificial Sequence
  derived and/or modified protein sequence (wt) from DENV-1__FJ410222__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAKRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3124 - protein, 3292 aa, Artificial Sequence
  derived and/or modified protein sequence (wt) from DENV-1__FJ461319__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLAAGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNVQVAINQVRRLIGNENYLDYMTSMKRFKNESDPEGALW

SEQ ID NO: 3125 - protein, 3292 aa, Artificial Sequence
  derived and/or modified protein sequence (wt) from DENV-1__FJ461320__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMVEEVMRSRWSRKMLMTGTLAVFLLLIMGQLTWNDLIRLCIMVGANASDRMGMGTTYLALMATFKIRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3126 - protein, 3292 aa, Artificial Sequence
  derived and/or modified protein sequence (wt) from DENV-1__FJ410225__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEISWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPARVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3127 - protein, 3292 aa, Artificial Sequence
  derived and/or modified protein sequence (wt) from DENV-1__FJ410226__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKDKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCMSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3128 - protein, 3292 aa, Artificial Sequence
  derived and/or modified protein sequence (wt) from DENV-1__FJ410227__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3129 - protein, 3292 aa, Artificial Sequence
  derived and/or modified protein sequence (wt) from DENV-1__FJ859029__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKGEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLVLCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEAKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3130 - protein, 3292 aa, Artificial Sequence
  derived and/or modified protein sequence (wt) from DENV-1__FJ547065__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDLRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTRNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRKWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3131 - protein, 3292 aa, Artificial Sequence
  derived and/or modified protein sequence (wt) from DENV-1__FJ410230__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALIGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMSSSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISRMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRLTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3132 - protein, 3292 aa, Artificial Sequence
  derived and/or modified protein sequence (wt) from DENV-1__FJ410231__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3133 - protein, 3292 aa, Artificial Sequence
  derived and/or modified protein sequence (wt) from DENV-1__FJ461323__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWVLRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNETDPEGALW

SEQ ID NO: 3134 - protein, 3292 aa, Artificial Sequence
  derived and/or modified protein sequence (wt) from DENV-1__FJ461325__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLITENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3135 - protein, 3292 aa, Artificial Sequence
  derived and/or modified protein sequence (wt) from DENV-1__FJ410232__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3136 - protein, 3292 aa, Artificial Sequence
  derived and/or modified protein sequence (wt) from DENV-1__FJ461327__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDMGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3137 - protein, 3292 aa, Artificial Sequence
  derived and/or modified protein sequence (wt) from DENV-1__FJ461328__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3138 - protein, 3292 aa, Artificial Sequence
  derived and/or modified protein sequence (wt) from DENV-1__FJ410234__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPSSLEELGDGLAMGIMILKLLTDFQSHQLWATLLSLTFIKTAFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3139 - protein, 3292 aa, Artificial Sequence
  derived and/or modified protein sequence (wt) from DENV-1__FJ410235__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITTNPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIVPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAIIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLGKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3140 - protein, 3292 aa, Artificial Sequence
  derived and/or modified protein sequence (wt) from DENV-1__FJ410236__SS-prME
SVTMLLMLVPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKAMKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVKRLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3141 - protein, 3292 aa, Artificial Sequence
  derived and/or modified protein sequence (wt) from DENV-1__FJ410238__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANTSDRMGMGTTYLALMATFKMRPMFAVGLLFRRLTSREVLLLTIGLSLVASAELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRVYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3142 - protein, 3292 aa, Artificial Sequence
  derived and/or modified protein sequence (wt) from DENV-1__FJ410239__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVFLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3143 - protein, 3292 aa, Artificial Sequence
  derived and/or modified protein sequence (wt) from DENV-1__FJ410240__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTAHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3144 - protein, 3292 aa, Artificial Sequence
  derived and/or modified protein sequence (wt) from DENV-1__FJ410242__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECSDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3145 - protein, 3292 aa, Artificial Sequence
  derived and/or modified protein sequence (wt) from DENV-1__FJ410243__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGPMKIKDEERDDMLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVILHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3146 - protein, 3292 aa, Artificial Sequence
  derived and/or modified protein sequence (wt) from DENV-1__FJ410244__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMNKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLNLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAIIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVPNLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3147 - protein, 3292 aa, Artificial Sequence
  derived and/or modified protein sequence (wt) from DENV-1__FJ410245__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNIGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKKKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3148 - protein, 3292 aa, Artificial Sequence
  derived and/or modified protein sequence (wt) from DENV-1__FJ410246__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKDKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMTEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVHEAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLERHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3149 - protein, 3292 aa, Artificial Sequence
  derived and/or modified protein sequence (wt) from DENV-1__FJ410247__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENRIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKQGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3150 - protein, 3292 aa, Artificial Sequence
  derived and/or modified protein sequence (wt) from DENV-1__FJ410248__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFVATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3151 - protein, 3292 aa, Artificial Sequence
  derived and/or modified protein sequence (wt) from DENV-1__FJ410249__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGERRRDKRSVALAPHVGLGLETRTETWMSSEGAWKQIQRVETWALRHPGFTVIALFLAHAIGTSITQKGIIFILLMLVTPSMAMRCVGVGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFFLIMGQLTWNDLIRLCIMVGANASDRMGMGTTYLALMATFKMRPMFAVGLLFRRLTSREVLLLTTGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3152 - protein, 3292 aa, Artificial Sequence
  derived and/or modified protein sequence (wt) from DENV-1__FJ410251__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGGKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3153 - protein, 3292 aa, Artificial Sequence
  derived and/or modified protein sequence (wt) from DENV-1__FJ410252__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTLVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDYRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3154 - protein, 3292 aa, Artificial Sequence
  derived and/or modified protein sequence (wt) from DENV-1__FJ461331__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPVVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3155 - protein, 3292 aa, Artificial Sequence
  derived and/or modified protein sequence (wt) from DENV-1__FJ410256__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSTTRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVVASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3156 - protein, 3292 aa, Artificial Sequence
  derived and/or modified protein sequence (wt) from DENV-1__FJ410257__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFTTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFSGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNYNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGDRKKLRPRWLDARTYSDPLALRELKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3157 - protein, 3292 aa, Artificial Sequence
  derived and/or modified protein sequence (wt) from DENV-1__FJ461332__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPVVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDVKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3158 - protein, 3292 aa, Artificial Sequence
  derived and/or modified protein sequence (wt) from DENV-1__FJ461333__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNVQVAINQVRRLIGNENYLDYMTSMKRFKNESDPEGALW

SEQ ID NO: 3159 - protein, 3292 aa, Artificial Sequence
  derived and/or modified protein sequence (wt) from DENV-1__FJ410262__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3160 - protein, 3292 aa, Artificial Sequence
  derived and/or modified protein sequence (wt) from DENV-1__FJ410263__SS-prME
SVTMLLMLMPTALAFHLTTRGGEPHMIVSKQERGKSLLFKTSAGVNMCTLIAMDLGELCEDIMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3161 - protein, 3292 aa, Artificial Sequence
  derived and/or modified protein sequence (wt) from DENV-1__FJ410264__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3162 - protein, 3292 aa, Artificial Sequence
  derived and/or modified protein sequence (wt) from DENV-1__FJ410265__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCTSIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3163 - protein, 3292 aa, Artificial Sequence
  derived and/or modified protein sequence (wt) from DENV-1__FJ461336__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVLTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3164 - protein, 3292 aa, Artificial Sequence
  derived and/or modified protein sequence (wt) from DENV-1__FJ410266__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSKKMLMTGTLAVFLLLIMGQLTWNDLIRLCIMVGANASDRMGMGTTYLALIATFKMRPMFAVGLLFRRLTSREVLLLTIGLSLVASVELPNSLEELGDGLAMGIMILKLLTDFQSHQLWATLLSFTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPGELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3165 - protein, 3292 aa, Artificial Sequence
  derived and/or modified protein sequence (wt) from DENV-1__FJ410269__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVEIPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3166 - protein, 3292 aa, Artificial Sequence
  derived and/or modified protein sequence (wt) from DENV-1__FJ410273__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFVATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILTQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3167 - protein, 3292 aa, Artificial Sequence
  derived and/or modified protein sequence (wt) from DENV-1__FJ410276__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3168 - protein, 3292 aa, Artificial Sequence
  derived and/or modified protein sequence (wt) from DENV-1__FJ410278__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQRKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3169 - protein, 3292 aa, Artificial Sequence
  derived and/or modified protein sequence (wt) from DENV-1__FJ410279__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARVYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3170 - protein, 3292 aa, Artificial Sequence
  derived and/or modified protein sequence (wt) from DENV-1__FJ410283__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3171 - protein, 3292 aa, Artificial Sequence
  derived and/or modified protein sequence (wt) from DENV-1__FJ410284__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEEKDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREATKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3172 - protein, 3292 aa, Artificial Sequence
  derived and/or modified protein sequence (wt) from DENV-1__FJ410285__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQHENLKYSVIVTVHTGDQHQVGNESTEHGTTATITPQAPTTEIQLTDYGALSLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGPGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLADFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3173 - protein, 3292 aa, Artificial Sequence
  derived and/or modified protein sequence (wt) from DENV-1__FJ410286__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3174 - protein, 3292 aa, Artificial Sequence
  derived and/or modified protein sequence (wt) from DENV-1__FJ461339__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQPHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVIASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGVGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETSNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3175 - protein, 3292 aa, Artificial Sequence
  derived and/or modified protein sequence (wt) from DENV-1__FJ882515__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWPQVPHCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEDDPEGALW

SEQ ID NO: 3176 - protein, 3292 aa, Artificial Sequence
  derived and/or modified protein sequence (wt) from DENV-1__FJ882517__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEEALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMVTFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3177 - protein, 3292 aa, Artificial Sequence
  derived and/or modified protein sequence (wt) from DENV-1__JQ287661__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3178 - protein, 3292 aa, Artificial Sequence
  derived and/or modified protein sequence (wt) from DENV-1__FJ882518__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPSTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3179 - protein, 3292 aa, Artificial Sequence
  derived and/or modified protein sequence (wt) from DENV-1__FJ882519__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3180 - protein, 3292 aa, Artificial Sequence
  derived and/or modified protein sequence (wt) from DENV-1__FJ882520__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3181 - protein, 3292 aa, Artificial Sequence
  derived and/or modified protein sequence (wt) from DENV-1__FJ882523__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDEEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3182 - protein, 3292 aa, Artificial Sequence
  derived and/or modified protein sequence (wt) from DENV-1__FJ882524__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANYVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVTASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3183 - protein, 3292 aa, Artificial Sequence
  derived and/or modified protein sequence (wt) from DENV-1__FJ882525__SS-prME
SVTMLLMLMPTALAFHLTTRGGEPHMIVSKQERGKSLLFKTSAGVNMCTLVAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIIGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNFVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3184 - protein, 3292 aa, Artificial Sequence
  derived and/or modified protein sequence (wt) from DENV-1__FJ882526__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGERALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3185 - protein, 3292 aa, Artificial Sequence
  derived and/or modified protein sequence (wt) from DENV-1__FJ882527__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLAMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3186 - protein, 3292 aa, Artificial Sequence
  derived and/or modified protein sequence (wt) from DENV-1__FJ882529__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDVKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMVHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3187 - protein, 3292 aa, Artificial Sequence
  derived and/or modified protein sequence (wt) from DENV-1__FJ882530__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3188 - protein, 3292 aa, Artificial Sequence
  derived and/or modified protein sequence (wt) from DENV-1__GQ868605__SS-prME
SVTMLLMLMPTALAFHLTTRGGEPHMIVTKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLSISIMIEEVMRSRWSRKMLMTGTLAVFLLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTALSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFETEYQKTKNNDWDYVVTTDISEMGANFRADRVIDPRRCLKPVILKDGSERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLIIEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3189 - protein, 3292 aa, Artificial Sequence
  derived and/or modified protein sequence (wt) from DENV-1__FJ882534__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGPQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIVENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3190 - protein, 3292 aa, Artificial Sequence
  derived and/or modified protein sequence (wt) from DENV-1__FJ882536__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3191 - protein, 3292 aa, Artificial Sequence
  derived and/or modified protein sequence (wt) from DENV-1__FJ882537__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTTGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMVRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEHMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3192 - protein, 3292 aa, Artificial Sequence
  derived and/or modified protein sequence (wt) from DENV-1__GQ868606__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPARNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3193 - protein, 3292 aa, Artificial Sequence
  derived and/or modified protein sequence (wt) from DENV-1__FJ882539__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGALASQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGITQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3194 - protein, 3292 aa, Artificial Sequence
  derived and/or modified protein sequence (wt) from DENV-1__FJ882541__SS-prME
SVTMLLMLIPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3195 - protein, 3292 aa, Artificial Sequence
  derived and/or modified protein sequence (wt) from DENV-1__FJ882542__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPSTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGMTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3196 - protein, 3292 aa, Artificial Sequence
  derived and/or modified protein sequence (wt) from DENV-1__FJ882543__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFLGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWASNIQVAINQVRRLIGNENYLDYMTSMKRFKNEGDPEGALW

SEQ ID NO: 3197 - protein, 3292 aa, Artificial Sequence
  derived and/or modified protein sequence (wt) from DENV-1__FJ882544__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKGKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISNIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3198 - protein, 3292 aa, Artificial Sequence
  derived and/or modified protein sequence (wt) from DENV-1__FJ898371__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMENKTHVSSWGDVPYLGKREDQWCGSLIGLTARATWASNIQVAINQVRRLIGNENYLDYMTSMKRFKNEGDPEGALW

SEQ ID NO: 3199 - protein, 3292 aa, Artificial Sequence
  derived and/or modified protein sequence (wt) from DENV-1__FJ882545__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3200 - protein, 3292 aa, Artificial Sequence
  derived and/or modified protein sequence (wt) from DENV-1__FJ898372__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMARDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3201 - protein, 3292 aa, Artificial Sequence
  derived and/or modified protein sequence (wt) from DENV-1__FJ898373__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTTGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAVGKAWEEGVCGIRSATRLENIMWRQISNELNHILLENDMKFTVVVGDVVGILAQGKKMVRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEHMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3202 - protein, 3292 aa, Artificial Sequence
  derived and/or modified protein sequence (wt) from DENV-1__FJ898374__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3203 - protein, 3292 aa, Artificial Sequence
  derived and/or modified protein sequence (wt) from DENV-1__FJ898375__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVEKHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3204 - protein, 3292 aa, Artificial Sequence
  derived and/or modified protein sequence (wt) from DENV-1__FJ898376__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANANCSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3205 - protein, 3292 aa, Artificial Sequence
  derived and/or modified protein sequence (wt) from DENV-1__FJ898379__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3206 - protein, 3292 aa, Artificial Sequence
  derived and/or modified protein sequence (wt) from DENV-1__GQ199773__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVTVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWNLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3207 - protein, 3292 aa, Artificial Sequence
  derived and/or modified protein sequence (wt) from DENV-1__JF937596__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFAPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3208 - protein, 3292 aa, Artificial Sequence
  derived and/or modified protein sequence (wt) from DENV-1__FJ898380__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3209 - protein, 3292 aa, Artificial Sequence
  derived and/or modified protein sequence (wt) from DENV-1__FJ898382__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPFSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSSDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3210 - protein, 3292 aa, Artificial Sequence
  derived and/or modified protein sequence (wt) from DENV-1__FJ898383__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPINIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3211 - protein, 3292 aa, Artificial Sequence
  derived and/or modified protein sequence (wt) from DENV-1__FJ898384__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIAIFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3212 - protein, 3292 aa, Artificial Sequence
  derived and/or modified protein sequence (wt) from DENV-1__FJ898385__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGGVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMILSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNMGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3213 - protein, 3292 aa, Artificial Sequence
  derived and/or modified protein sequence (wt) from DENV-1__GQ868608__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWKEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDMLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3214 - protein, 3292 aa, Artificial Sequence
  derived and/or modified protein sequence (wt) from DENV-1__GQ199774__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTTGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMVRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVREKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEHMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3215 - protein, 3292 aa, Artificial Sequence
  derived and/or modified protein sequence (wt) from DENV-1__GQ199775__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTTGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMVRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVREKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEHMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRIWTREEVTRKVRSNAGIGAGVGDENQWNSAKKGVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3216 - protein, 3291 aa, Artificial Sequence
  derived and/or modified protein sequence (wt) from DENV-1__FJ882546__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRKSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTELHLGQQRVFKEKVDTRTPRAKRGTAQIMEMTARWLWGFLSRNKIPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEEIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3217 - protein, 3292 aa, Artificial Sequence
  derived and/or modified protein sequence (wt) from DENV-1__KF921935__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKEMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3218 - protein, 3292 aa, Artificial Sequence
  derived and/or modified protein sequence (wt) from DENV-1__GQ199776__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVVVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3219 - protein, 3292 aa, Artificial Sequence
  derived and/or modified protein sequence (wt) from DENV-1__GQ199777__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLADFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3220 - protein, 3292 aa, Artificial Sequence
  derived and/or modified protein sequence (wt) from DENV-1__GQ199778__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQEAWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPIKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3221 - protein, 3292 aa, Artificial Sequence
  derived and/or modified protein sequence (wt) from DENV-1__GQ199780__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3222 - protein, 3292 aa, Artificial Sequence
  derived and/or modified protein sequence (wt) from DENV-1__GQ199781__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADAQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIIREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFAPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKARRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3223 - protein, 3292 aa, Artificial Sequence
  derived and/or modified protein sequence (wt) from DENV-1__GQ199782__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADIQNTTFIIDGPNTPECPDDQRAWNIWEVEDYGFGIFTTNIWLRLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMVEEVMRSRWSRKMLMTGTLAVFLLLIMGQLTWNDLIRLCIMVGANASDRMGMGTTYLALMATFKIRPMFAVGLLVRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENMKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3224 - protein, 3292 aa, Artificial Sequence
  derived and/or modified protein sequence (wt) from DENV-1__GQ199783__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGTSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSSTRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKIRPMFAVGLLFRRLTSREVLLLTIGLSLVASVELPNSLEELGDGLAMGIMILKLLTDFQSHQLWATLLSLTFIKTTLSLHHAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3225 - protein, 3292 aa, Artificial Sequence
  derived and/or modified protein sequence (wt) from DENV-1__GQ199784__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3226 - protein, 3292 aa, Artificial Sequence
  derived and/or modified protein sequence (wt) from DENV-1__GQ199785__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMKPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3227 - protein, 3292 aa, Artificial Sequence
  derived and/or modified protein sequence (wt) from DENV-1__GQ199786__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVILFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3228 - protein, 3292 aa, Artificial Sequence
  derived and/or modified protein sequence (wt) from DENV-1__GQ199787__SS-prME
SVTMLLMLVPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNEDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3229 - protein, 3292 aa, Artificial Sequence
  derived and/or modified protein sequence (wt) from DENV-1__GQ199788__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3230 - protein, 3292 aa, Artificial Sequence
  derived and/or modified protein sequence (wt) from DENV-1__GQ199789__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKGEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLVLCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNIEAQLIRQMESEEIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3231 - protein, 3292 aa, Artificial Sequence
  derived and/or modified protein sequence (wt) from DENV-1__GQ199790__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3232 - protein, 3292 aa, Artificial Sequence
  derived and/or modified protein sequence (wt) from DENV-1__GQ199791__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGVLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGAFW

SEQ ID NO: 3233 - protein, 3292 aa, Artificial Sequence
  derived and/or modified protein sequence (wt) from DENV-1__GQ199792__SS-prME
SVTMLLMLMPTALAFHLTTRGGEPHMIVSKQERGKSLLFKTSAGVNMCTLIAMDLGELCEDTMTYKCPRITEAEPDDVDCWCNATDAWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNMGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPGDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3234 - protein, 3292 aa, Artificial Sequence
  derived and/or modified protein sequence (wt) from DENV-1__GQ199793__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNAGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3235 - protein, 3292 aa, Artificial Sequence
  derived and/or modified protein sequence (wt) from DENV-1__GQ199795__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEDPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3236 - protein, 3290 aa, Artificial Sequence
  derived and/or modified protein sequence (wt) from DENV-1__FJ882547__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGIGTTYLALMATFKMRPMFAVGLLFRRLTSREVLLLTIGLSLVASVELPNSLEELGDGLAMGIMMLKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGEGKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMSPIAMTDTTPLAQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEEIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3237 - protein, 3292 aa, Artificial Sequence
  derived and/or modified protein sequence (wt) from DENV-1__GQ199797__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETMMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3238 - protein, 3292 aa, Artificial Sequence
  derived and/or modified protein sequence (wt) from DENV-1__GQ199799__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQPHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3239 - protein, 3292 aa, Artificial Sequence
  derived and/or modified protein sequence (wt) from DENV-1__GQ199800__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3240 - protein, 3292 aa, Artificial Sequence
  derived and/or modified protein sequence (wt) from DENV-1__FJ882548__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3241 - protein, 3292 aa, Artificial Sequence
  derived and/or modified protein sequence (wt) from DENV-1__GQ199801__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTRLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSKKMLMTGTLAVFFLLIMGQLTWNDLIRLCIMVGANASDRMGMGTTYLALMATFKMRPMLAVGLLFRRLTSREVLLLTIGLSLVASVELPNSLEELGDGLAMGIMILKLLTDFQSHQLWATLLSLTFIKTTYSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIENEVFRKRNLTIMDLHPGSGKTRRYLPAIVREAIKRKLRTLILAPTRVVASEMAEALKGIPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3242 - protein, 3292 aa, Artificial Sequence
  derived and/or modified protein sequence (wt) from DENV-1__GQ199802__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWVFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3243 - protein, 3292 aa, Artificial Sequence
  derived and/or modified protein sequence (wt) from DENV-1__JF937597__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALNWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3244 - protein, 3292 aa, Artificial Sequence
  derived and/or modified protein sequence (wt) from DENV-1__GQ868609__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLRLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3245 - protein, 3292 aa, Artificial Sequence
  derived and/or modified protein sequence (wt) from DENV-1__GQ199803__SS-prME
SVTMLLMLMPTALAFHLTIRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPSSLEELGDGLAMGIMILKLLTDFQSHQLWATLLSLTFIKTAFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGDRKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3246 - protein, 3292 aa, Artificial Sequence
  derived and/or modified protein sequence (wt) from DENV-1__GQ199804__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGDATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3247 - protein, 3292 aa, Artificial Sequence
  derived and/or modified protein sequence (wt) from DENV-1__GQ199805__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLAMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLATSIFKLTYQNKVVRVQRPAKNGTVMDVISRRDQRGSGQVGTYGLNTFTNMEAQLIRQMESEGIFLPSELETQNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3248 - protein, 3292 aa, Artificial Sequence
  derived and/or modified protein sequence (wt) from DENV-1__GQ199806__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEAVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIVVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQDGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLNSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3249 - protein, 3292 aa, Artificial Sequence
  derived and/or modified protein sequence (wt) from DENV-1__GQ199809__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANANCSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3250 - protein, 3292 aa, Artificial Sequence
  derived and/or modified protein sequence (wt) from DENV-1__GQ199810__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEVEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGDPEGALW

SEQ ID NO: 3251 - protein, 3292 aa, Artificial Sequence
  derived and/or modified protein sequence (wt) from DENV-1__GQ199811__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNYILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFVRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3252 - protein, 3292 aa, Artificial Sequence
  derived and/or modified protein sequence (wt) from DENV-1__FJ882549__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVLKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3253 - protein, 3292 aa, Artificial Sequence
  derived and/or modified protein sequence (wt) from DENV-1__GQ199814__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKDKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMTEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3254 - protein, 3292 aa, Artificial Sequence
  derived and/or modified protein sequence (wt) from DENV-1__GQ199816__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGILAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3255 - protein, 3292 aa, Artificial Sequence
  derived and/or modified protein sequence (wt) from DENV-1__GQ199817__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLIPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWCFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFLLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3256 - protein, 3292 aa, Artificial Sequence
  derived and/or modified protein sequence (wt) from DENV-1__FJ882550__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGMTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3257 - protein, 3292 aa, Artificial Sequence
  derived and/or modified protein sequence (wt) from DENV-1__FJ882551__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIIGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKQEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLKKHGVERLKRMAISGDDCVVKPIDDRFATALTALNDMGKVRKDIPQWEPSKGWNDWQQVPFCSHHFHQLIMKDGRELVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3258 - protein, 3292 aa, Artificial Sequence
  derived and/or modified protein sequence (wt) from DENV-1__FJ882552__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTSSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTNHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3259 - protein, 3292 aa, Artificial Sequence
  derived and/or modified protein sequence (wt) from DENV-1__FJ882553__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFRKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESEPEGALW

SEQ ID NO: 3260 - protein, 3292 aa, Artificial Sequence
  derived and/or modified protein sequence (wt) from DENV-1__FJ882554__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPYSIAARGYISTRVGMGEAAAIFMTATPPGSVEAFPQSNAVIKDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3261 - protein, 3292 aa, Artificial Sequence
  derived and/or modified protein sequence (wt) from DENV-1__GQ868610__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALIATFKMRPMFAVGLLFRRLTSREVLLLTIGLSLVASVELPNSLEELGDGLAMGIMILKLLTDFQSHQLWATLLSFTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3262 - protein, 3292 aa, Artificial Sequence
  derived and/or modified protein sequence (wt) from DENV-1__GQ868611__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3263 - protein, 3292 aa, Artificial Sequence
  derived and/or modified protein sequence (wt) from DENV-1__FJ882555__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASASQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGQNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKVVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3264 - protein, 3292 aa, Artificial Sequence
  derived and/or modified protein sequence (wt) from DENV-1__GQ199821__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIVVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWIASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3265 - protein, 3292 aa, Artificial Sequence
  derived and/or modified protein sequence (wt) from DENV-1__FJ882556__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVSDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3266 - protein, 3292 aa, Artificial Sequence
  derived and/or modified protein sequence (wt) from DENV-1__GQ199822__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGRAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPALVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3267 - protein, 3292 aa, Artificial Sequence
  derived and/or modified protein sequence (wt) from DENV-1__FJ882557__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTMTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3268 - protein, 3292 aa, Artificial Sequence
  derived and/or modified protein sequence (wt) from DENV-1__FJ882558__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLTVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETMMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3269 - protein, 3292 aa, Artificial Sequence
  derived and/or modified protein sequence (wt) from DENV-1__GQ199824__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQILNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3270 - protein, 3292 aa, Artificial Sequence
  derived and/or modified protein sequence (wt) from DENV-1__FJ882559__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKARIIGADVQNTTFIIDGPNTPECPDDQRAWNIWEVEDYGFGIFTTNIWLRLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIVHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVRLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3271 - protein, 3292 aa, Artificial Sequence
  derived and/or modified protein sequence (wt) from DENV-1__GQ199828__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVRESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKNEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEEIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLADKAIGSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3272 - protein, 3292 aa, Artificial Sequence
  derived and/or modified protein sequence (wt) from DENV-1__GQ199829__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTLVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPRSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3273 - protein, 3292 aa, Artificial Sequence
  derived and/or modified protein sequence (wt) from DENV-1__FJ882562__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGLFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMTSSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3274 - protein, 3292 aa, Artificial Sequence
  derived and/or modified protein sequence (wt) from DENV-1__FJ882564__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMVAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3275 - protein, 3292 aa, Artificial Sequence
  derived and/or modified protein sequence (wt) from DENV-1__FJ882565__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRGSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3276 - protein, 3292 aa, Artificial Sequence
  derived and/or modified protein sequence (wt) from DENV-1__FJ882567__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3277 - protein, 3292 aa, Artificial Sequence
  derived and/or modified protein sequence (wt) from DENV-1__GQ199831__SS-prME
SVTMLLMLMPTALAFHLTTRGGEPHMIVTKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKYGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSADPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3278 - protein, 3292 aa, Artificial Sequence
  derived and/or modified protein sequence (wt) from DENV-1__GQ199832__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYKHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3279 - protein, 3292 aa, Artificial Sequence
  derived and/or modified protein sequence (wt) from DENV-1__FJ882568__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTVVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3280 - protein, 3292 aa, Artificial Sequence
  derived and/or modified protein sequence (wt) from DENV-1__FJ882569__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRRSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3281 - protein, 3292 aa, Artificial Sequence
  derived and/or modified protein sequence (wt) from DENV-1__GQ199833__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDRRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKGKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3282 - protein, 3292 aa, Artificial Sequence
  derived and/or modified protein sequence (wt) from DENV-1__FJ882570__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNIFVEVQDDGTMKIKDEERDDTLTILLKATLLAVSGVYPLSIPATLFVWYFWQKKKQRSGVLWDTPSPPEVERAALDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3283 - protein, 3292 aa, Artificial Sequence
  derived and/or modified protein sequence (wt) from DENV-1__GQ199834__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVDGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3284 - protein, 3292 aa, Artificial Sequence
  derived and/or modified protein sequence (wt) from DENV-1__GQ199835__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLTLMATFKMRPMFAVGLLLRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3285 - protein, 3292 aa, Artificial Sequence
  derived and/or modified protein sequence (wt) from DENV-1__FJ898386__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWASNIQVAINQVRRLIGNENYLDYMTSMKRFKNEGDPEGAFW

SEQ ID NO: 3286 - protein, 3292 aa, Artificial Sequence
  derived and/or modified protein sequence (wt) from DENV-1__FJ898387__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3287 - protein, 3292 aa, Artificial Sequence
  derived and/or modified protein sequence (wt) from DENV-1__FJ898389__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLFLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSFGCKPLAMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPFSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3288 - protein, 3292 aa, Artificial Sequence
  derived and/or modified protein sequence (wt) from DENV-1__FJ898390__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3289 - protein, 3292 aa, Artificial Sequence
  derived and/or modified protein sequence (wt) from DENV-1__FJ898391__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3290 - protein, 3292 aa, Artificial Sequence
  derived and/or modified protein sequence (wt) from DENV-1__FJ898392__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3291 - protein, 3292 aa, Artificial Sequence
  derived and/or modified protein sequence (wt) from DENV-1__FJ898393__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3292 - protein, 3292 aa, Artificial Sequence
  derived and/or modified protein sequence (wt) from DENV-1__FJ898394__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTPQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANVSDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMTHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3293 - protein, 3292 aa, Artificial Sequence
  derived and/or modified protein sequence (wt) from DENV-1__GQ199838__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTLVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3294 - protein, 3292 aa, Artificial Sequence
  derived and/or modified protein sequence (wt) from DENV-1__FJ898396__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASITLEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3295 - protein, 3292 aa, Artificial Sequence
  derived and/or modified protein sequence (wt) from DENV-1__GQ199839__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSRTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGLKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNIFVEVQDDGTMKIKDEERDDTLTILLKATLLAVSGVYPLSIPATLFVWYFWQKKKQRSGVLWDTPSPPEVERAALDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3296 - protein, 3292 aa, Artificial Sequence
  derived and/or modified protein sequence (wt) from DENV-1__FJ898397__SS-prME
SVTMLLMLMPTALAFHLTIRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3297 - protein, 3292 aa, Artificial Sequence
  derived and/or modified protein sequence (wt) from DENV-1__FJ898398__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEESMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLNWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3298 - protein, 3292 aa, Artificial Sequence
  derived and/or modified protein sequence (wt) from DENV-1__FJ898399__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3299 - protein, 3292 aa, Artificial Sequence
  derived and/or modified protein sequence (wt) from DENV-1__FJ898401__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDGHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEKEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAHGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3300 - protein, 3292 aa, Artificial Sequence
  derived and/or modified protein sequence (wt) from DENV-1__FJ898402__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWTASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3301 - protein, 3292 aa, Artificial Sequence
  derived and/or modified protein sequence (wt) from DENV-1__FJ898403__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3302 - protein, 3292 aa, Artificial Sequence
  derived and/or modified protein sequence (wt) from DENV-1__FJ898404__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3303 - protein, 3292 aa, Artificial Sequence
  derived and/or modified protein sequence (wt) from DENV-1__GQ199840__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLITGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDIPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3304 - protein, 3292 aa, Artificial Sequence
  derived and/or modified protein sequence (wt) from DENV-1__FJ898405__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSNIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3305 - protein, 3292 aa, Artificial Sequence
  derived and/or modified protein sequence (wt) from DENV-1__FJ898406__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSNIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMASMKRFKNEGDPEGALW

SEQ ID NO: 3306 - protein, 3292 aa, Artificial Sequence
  derived and/or modified protein sequence (wt) from DENV-1__GQ199841__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3307 - protein, 3292 aa, Artificial Sequence
  derived and/or modified protein sequence (wt) from DENV-1__FJ898407__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3308 - protein, 3292 aa, Artificial Sequence
  derived and/or modified protein sequence (wt) from DENV-1__FJ898408__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSADPGDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3309 - protein, 3292 aa, Artificial Sequence
  derived and/or modified protein sequence (wt) from DENV-1__GQ199843__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3310 - protein, 3292 aa, Artificial Sequence
  derived and/or modified protein sequence (wt) from DENV-1__GQ199844__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3311 - protein, 3292 aa, Artificial Sequence
  derived and/or modified protein sequence (wt) from DENV-1__GQ199845__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGMFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREATKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3312 - protein, 3292 aa, Artificial Sequence
  derived and/or modified protein sequence (wt) from DENV-1__GQ199846__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTIMARDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3313 - protein, 3292 aa, Artificial Sequence
  derived and/or modified protein sequence (wt) from DENV-1__GQ199847__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSADPDDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3314 - protein, 3292 aa, Artificial Sequence
  derived and/or modified protein sequence (wt) from DENV-1__GQ199849__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSRTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLALKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGLKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESERNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCTSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNIFVEVQDDGTMKIKDEERDDTLTILLKATLLAVSGVYPLSIPATLFVWYFWQKKKQRSGVLWDTPSPPEVERAALDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQTKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFIILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3315 - protein, 3292 aa, Artificial Sequence
  derived and/or modified protein sequence (wt) from DENV-1__FJ898410__SS-prME
SVTMLLMLTPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKIWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3316 - protein, 3292 aa, Artificial Sequence
  derived and/or modified protein sequence (wt) from DENV-1__FJ898411__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3317 - protein, 3292 aa, Artificial Sequence
  derived and/or modified protein sequence (wt) from DENV-1__FJ898412__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHVTMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3318 - protein, 3292 aa, Artificial Sequence
  derived and/or modified protein sequence (wt) from DENV-1__GQ199852__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLTTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLPLHCAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3319 - protein, 3292 aa, Artificial Sequence
  derived and/or modified protein sequence (wt) from DENV-1__FJ898415__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSNIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3320 - protein, 3292 aa, Artificial Sequence
  derived and/or modified protein sequence (wt) from DENV-1__FJ898416__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKTSQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGVLW

SEQ ID NO: 3321 - protein, 3292 aa, Artificial Sequence
  derived and/or modified protein sequence (wt) from DENV-1__FJ898417__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSADPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3322 - protein, 3292 aa, Artificial Sequence
  derived and/or modified protein sequence (wt) from DENV-1__GQ868612__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASLIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3323 - protein, 3292 aa, Artificial Sequence
  derived and/or modified protein sequence (wt) from DENV-1__FJ898419__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGWTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3324 - protein, 3292 aa, Artificial Sequence
  derived and/or modified protein sequence (wt) from DENV-1__FJ898420__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGAMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGRLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHKRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3325 - protein, 3292 aa, Artificial Sequence
  derived and/or modified protein sequence (wt) from DENV-1__FJ898421__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLSISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESGPEGALW

SEQ ID NO: 3326 - protein, 3292 aa, Artificial Sequence
  derived and/or modified protein sequence (wt) from DENV-1__FJ898423__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIIQYENLKYSVIVTVHTGDQHQVGNESTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTTGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMVRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEHMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3327 - protein, 3292 aa, Artificial Sequence
  derived and/or modified protein sequence (wt) from DENV-1__FJ898424__SS-prME
SVTMLLMLMPTALAFHLTTRGGEPHMIVSKQERGKSLLFKTSTGVNMCTLIAMDLGELCEDTMTYKCPRITEVEPDDVDCWCNTTDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPARNGTVMDVISRRDQRGSGQVGTYGLNTFTNMEAQLIRQMESEGIFSPSELETPNLAERVLDWLEKHGVERLKRMAISGDDCVVKPIDDRFATALSALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3328 - protein, 3292 aa, Artificial Sequence
  derived and/or modified protein sequence (wt) from DENV-1__FJ898425__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3329 - protein, 3292 aa, Artificial Sequence
  derived and/or modified protein sequence (wt) from DENV-1__FJ898426__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVANPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRRHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3330 - protein, 3292 aa, Artificial Sequence
  derived and/or modified protein sequence (wt) from DENV-1__GQ199856__SS-prME
SVTMLLMLMPTALAFHLTTRGGEPHMIVSKQERGKSLLFKTSAGVNMCTLVAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIIGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNFVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLERMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKLTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3331 - protein, 3292 aa, Artificial Sequence
  derived and/or modified protein sequence (wt) from DENV-1__FJ898427__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHCAWKTMAMVLSIASLFPLCLSTTSQKTTWLPVLLGSLGCKPLTMFLITETKIWGRKSWPLNEGIMAVGVVSILLSSLLKNDVPLAGPLIAGGMLIACYVISGSSADLSLEKAAEVSWEEEAEHSGASHNILVVVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3332 - protein, 3292 aa, Artificial Sequence
  derived and/or modified protein sequence (wt) from DENV-1__JF937599__SS-prME
SVTMLLMLMPTALAFHLTARGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEVQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3333 - protein, 3292 aa, Artificial Sequence
  derived and/or modified protein sequence (wt) from DENV-1__FJ898431__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVLFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3334 - protein, 3292 aa, Artificial Sequence
  derived and/or modified protein sequence (wt) from DENV-1__GU131678__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCMTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFKATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFLLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNPNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFAGERNNQVLEENMDVEIWTKEGERKKLLPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMGSVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLAKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGPAKLRWFVERTLVNPEGKVIALGCGRGAWSYYCAGLKKGTEVKGYTKGGPGHEEPIPMATYGWDLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVDPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCPTCVYNMMGKREKKLGEFGKAKGSRPIWYMWLGARFLEFEALGFMNEDHWFSRENSLSGVEGEALHKLGYILRDISKIPGGNMYADDTAGWDTRITEDDLQNEGKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWTLRETACLGKSYAQMWQLMYFPRRALRLAANAICSAVPVDWVPTSRTTWSIHAHHQWMTTEDMLSVWNRVWIEENPWMEDKTRISSWEDVPYLGKREDQWCGSLIGLTPRATWPTNIQVAINQVRRLIGNENYSDYMTSMKRFKNESEPEGALW

SEQ ID NO: 3335 - protein, 3292 aa, Artificial Sequence
  derived and/or modified protein sequence (wt) from DENV-1__GU131679__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKAWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDMLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIELDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEIDPEGALW

SEQ ID NO: 3336 - protein, 3292 aa, Artificial Sequence
  derived and/or modified protein sequence (wt) from DENV-1__GU131680__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3337 - protein, 3292 aa, Artificial Sequence
  derived and/or modified protein sequence (wt) from DENV-1__GU131681__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKVLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFSPSELEIPNLAERVLDWLEKYGVERLKRMAISGDDCVVKPIDDRFATALTALNDMGKVRKDVPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3338 - protein, 3292 aa, Artificial Sequence
  derived and/or modified protein sequence (wt) from DENV-1__GU131682__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3339 - protein, 3292 aa, Artificial Sequence
  derived and/or modified protein sequence (wt) from DENV-1__GU131683__SS-prME
SVTMLLMLMPTALAFHLTTRGGEPHMIVSKQERGKSLLFKTPAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLAHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARAFFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3340 - protein, 3292 aa, Artificial Sequence
  derived and/or modified protein sequence (wt) from DENV-1__GU131684__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSKVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3341 - protein, 3292 aa, Artificial Sequence
  derived and/or modified protein sequence (wt) from DENV-1__GU131685__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMEKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3342 - protein, 3292 aa, Artificial Sequence
  derived and/or modified protein sequence (wt) from DENV-1__GQ868614__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGPFKLEKEVAETQHGTVLVQIKYEGTDAPCKIPFSTQDEKGVIQNGRLITANPIVTDKEKPVNIEAEPPFGESYIVIGVGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3343 - protein, 3292 aa, Artificial Sequence
  derived and/or modified protein sequence (wt) from DENV-1__GU131688__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3344 - protein, 3292 aa, Artificial Sequence
  derived and/or modified protein sequence (wt) from DENV-1__GU131689__SS-prME
SVTMFLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAMKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLLGNENYLDYMTSMKRFKNESDPEGALW

SEQ ID NO: 3345 - protein, 3292 aa, Artificial Sequence
  derived and/or modified protein sequence (wt) from DENV-1__GU131690__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3346 - protein, 3292 aa, Artificial Sequence
  derived and/or modified protein sequence (wt) from DENV-1__GU131695__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRTCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3347 - protein, 3292 aa, Artificial Sequence
  derived and/or modified protein sequence (wt) from DENV-1__GU131697__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQYQVGNESTEHGTTATITPQAPTTEIQLTDYGALTLDCSPRTGLDFNEMVLLTMKEKSWLVHKQWFLDLPLPWTSGASTSQETWNKQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANAFDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3348 - protein, 3292 aa, Artificial Sequence
  derived and/or modified protein sequence (wt) from DENV-1__GU131700__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLTVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETMMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3349 - protein, 3292 aa, Artificial Sequence
  derived and/or modified protein sequence (wt) from DENV-1__GU131701__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVTALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPTVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDAFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHRLGYILRDISKIPGGNMYADDTAGWDTRITEDDLQNEARITDIMEPEHALLAKSIFKLTYQNKVVRVQRPGKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3350 - protein, 3292 aa, Artificial Sequence
  derived and/or modified protein sequence (wt) from DENV-1__GU131703__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3351 - protein, 3292 aa, Artificial Sequence
  derived and/or modified protein sequence (wt) from DENV-1__GU131706__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFRKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3352 - protein, 3292 aa, Artificial Sequence
  derived and/or modified protein sequence (wt) from DENV-1__GU131708__SS-prME
SVTMLLMLMPTALAFHLTTRGGEPHMVVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTSSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVAGILAQGKKMIRPQPMEYKYSWKSWGKAKIMGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3353 - protein, 3292 aa, Artificial Sequence
  derived and/or modified protein sequence (wt) from DENV-1__GU131710__SS-prME
SVTMLLMLMPTALAFHLTTRGGEPHMIASKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQRKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3354 - protein, 3292 aa, Artificial Sequence
  derived and/or modified protein sequence (wt) from DENV-1__GU131717__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMHQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3355 - protein, 3292 aa, Artificial Sequence
  derived and/or modified protein sequence (wt) from DENV-1__GU131718__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESIEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVIDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3356 - protein, 3292 aa, Artificial Sequence
  derived and/or modified protein sequence (wt) from DENV-1__GU131720__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFATNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSFGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMKPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3357 - protein, 3292 aa, Artificial Sequence
  derived and/or modified protein sequence (wt) from DENV-1__HM181960__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGRVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3358 - protein, 3292 aa, Artificial Sequence
  derived and/or modified protein sequence (wt) from DENV-1__HM181963__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQIGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKVVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3359 - protein, 3292 aa, Artificial Sequence
  derived and/or modified protein sequence (wt) from DENV-1__HM181964__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPLSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3360 - protein, 3292 aa, Artificial Sequence
  derived and/or modified protein sequence (wt) from DENV-1__HM181966__SS-prME
SVTMLLMLMPTALAFHLTTRGGEPHMIVTKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTLDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALIATFKMRPMFAVGLLFRRLTSREVLLLTIGLSLVASVELPNSLEELGDGLAMGIMILKLLTDFQSHQLWATLLSFTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLVMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3361 - protein, 3292 aa, Artificial Sequence
  derived and/or modified protein sequence (wt) from DENV-1__GU131721__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIIIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIVPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIIIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLRPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEGEPEGALW

SEQ ID NO: 3362 - protein, 3292 aa, Artificial Sequence
  derived and/or modified protein sequence (wt) from DENV-1__GU131723__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3363 - protein, 3292 aa, Artificial Sequence
  derived and/or modified protein sequence (wt) from DENV-1__GU131725__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFSEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILGQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLRGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKGEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSRGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 3364 - protein, 3292 aa, Artificial Sequence
  derived and/or modified protein sequence (wt) from DENV-1__GU131726__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFATNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLLRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSFGCKPLTMFLITENKIWGRKSWPLNEGIMAVGVVSILLSSLLKNDVPLAGPLIAGGMLIACYVISGSSPDLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3365 - protein, 3292 aa, Artificial Sequence
  derived and/or modified protein sequence (wt) from DENV-1__GU131727__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMYLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3366 - protein, 3292 aa, Artificial Sequence
  derived and/or modified protein sequence (wt) from DENV-1__HM631850__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSPDLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWGDVPYLGKREDQWCGSLIGLTARATWATNIQVAINQVRRLIGNENYLDYMTSMKRFKNESDPEGALW

SEQ ID NO: 3367 - protein, 3292 aa, Artificial Sequence
  derived and/or modified protein sequence (wt) from DENV-1__KF955446__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEAEVFRKRNLTIMDLHPGSGKTRRYLPAIVREAIKRKLRTLILAPTRVGASEMAEALKGMPIRYQTTAVKSEHTGKEIVDLMGHATFTMGLLAPGRVPNYNMVIMDEAHFTDPSRIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLNPVILKDGPERVILAGPMPVTVASAAQRRGRIGRNHNKEGDQYIYMGQPLNNDEDHAPWTEAKMLLDNINTPEGIIPALFEPEREKSAAIDGESRLRGEARKTFVELMRRGDLPVWLSYKVASEGFQYSDRRWCFDGERTNQVLEENMAVEIWPKEGERKKLRPRCLDARTYSDPLALREFKEFPPGRRSVSGDLILEIGKLPHPLTQRPQNALATLVMSHTSEQGGRAYRHAMEELPATIETLMLLALIAVLTGGVTLFFLSGRGLGKTSIGLLCVMASSVLLWMASVEPHWIAASIILEFFLMVLLIPEPDSNATRQDNQLAYVVIGLLFMILTVAANEMGLLETTKKDLGIGHVAVENHHHAAMLDVDLHPASAWTLYAVATTIITPMMRHTIENTTANISLTAIANQAAILMGLAKGWPISKMDIGVPLLALGCYSQVNPLTLTAPVLMLVPHYPIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLTKSEFNTYKRSGIMEVDRSEAKEGLKRGETTKHPVSRGTAKLRWFVERTLVKPEGKVIDLGCGRGGWSYYCAGLKKVTEVKGYTKGGPGHEDPIPMGTYGWNLVKLRSGKDVFFIPPEKCDTLLCDIGESSPNPTIEEGRTLRVLKMVEPWLRGNQFCIKILNPYMASVVETLEQMQRKHGGMLVRNPLSRNSTHEMYWVSWGTGNIVSAVNMTSRMLLNRFTMAHRKPTYERDVDLGAGTRHVAVEPEVANLDIIGQRIENIKHEHKSTWHYDEDNPYKTWAYHGSYEGKPSGSASSMVNGGVKLLTKPWDGIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESGGIFSPRELETPNLAERVLDWVEKYGVERLERMAISGDDCLGEPIYDRFATALTALNDMGKVRKDIPQWEPSKGWNDWQQGPFCSHHFHQLIMKDGREIVVPCRNQDELVGRARVSQGAGWSLRETACLGKSYAQMWQLMDFHRRDLRLAANAIWSAGPGDWIPTRRTTWSIHAHHQWMTTEDMLSVWNRVWIEENPWMEDKTHISSWGDVPYLGKREDQWCGSLIGLTARATWATNIQVAINQVRRLIGNENYLDYMASMKRFKNESDPEGALW

SEQ ID NO: 3368 - protein, 3292 aa, Artificial Sequence
  derived and/or modified protein sequence (wt) from DENV-1__KF921942__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVANPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3369 - protein, 3292 aa, Artificial Sequence
  derived and/or modified protein sequence (wt) from DENV-1__JF937602__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNYILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFVRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3370 - protein, 3292 aa, Artificial Sequence
  derived and/or modified protein sequence (wt) from DENV-1__GU131729__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLGKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGPMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRAARVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERTLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEGKPSGSASSMGNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3371 - protein, 3292 aa, Artificial Sequence
  derived and/or modified protein sequence (wt) from DENV-1__GU131730__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVRADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTTMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNPNKEGDQYIYMGQPLNNDEDHAPWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3372 - protein, 3292 aa, Artificial Sequence
  derived and/or modified protein sequence (wt) from DENV-1__GU131731__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRTHNKEGDQYISMGQPLNTAEDHAPWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEDPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3373 - protein, 3292 aa, Artificial Sequence
  derived and/or modified protein sequence (wt) from DENV-1__GU131733__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANIDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3374 - protein, 3292 aa, Artificial Sequence
  derived and/or modified protein sequence (wt) from DENV-1__GU131734__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTDSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLIDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3375 - protein, 3292 aa, Artificial Sequence
  derived and/or modified protein sequence (wt) from DENV-1__GU131738__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVIQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPGRSWNSGYEWITDFPGKTVWFGPTIKSGNDIANCLRKNGKRVIQLSRKTFDTEYQKTKNNDWDYVGTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLGQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3376 - protein, 3292 aa, Artificial Sequence
  derived and/or modified protein sequence (wt) from DENV-1__JF937604__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQTFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGFWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYADPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKQGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISQIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3377 - protein, 3292 aa, Artificial Sequence
  derived and/or modified protein sequence (wt) from DENV-1__JF937605__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTLQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAKVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWANVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3378 - protein, 3292 aa, Artificial Sequence
  derived and/or modified protein sequence (wt) from DENV-1__JF937608__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3379 - protein, 3292 aa, Artificial Sequence
  derived and/or modified protein sequence (wt) from DENV-1__GU131739__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTPTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3380 - protein, 3292 aa, Artificial Sequence
  derived and/or modified protein sequence (wt) from DENV-1__GU131740__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDVPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSFTFIKTTFSLHYAWKTMAMVLSIVSLFPLCLSTTSQKTTWLPVLLGSLGCKPLTMFLIAENKVWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3381 - protein, 3292 aa, Artificial Sequence
  derived and/or modified protein sequence (wt) from DENV-1__GU131741__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGVSTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3382 - protein, 3292 aa, Artificial Sequence
  derived and/or modified protein sequence (wt) from DENV-1__GU131743__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDVIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3383 - protein, 3292 aa, Artificial Sequence
  derived and/or modified protein sequence (wt) from DENV-1__JN093516__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATTRGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3384 - protein, 3292 aa, Artificial Sequence
  derived and/or modified protein sequence (wt) from DENV-1__GU131746__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3385 - protein, 3292 aa, Artificial Sequence
  derived and/or modified protein sequence (wt) from DENV-1__JF937609__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3386 - protein, 3292 aa, Artificial Sequence
  derived and/or modified protein sequence (wt) from DENV-1__KF921949__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFRKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVTGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTKKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3387 - protein, 3292 aa, Artificial Sequence
  derived and/or modified protein sequence (wt) from DENV-1__GU131747__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSAGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVFLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTVLLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3388 - protein, 3292 aa, Artificial Sequence
  derived and/or modified protein sequence (wt) from DENV-1__GU131748__SS-prME
SVTMLFMLVPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVKRLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3389 - protein, 3292 aa, Artificial Sequence
  derived and/or modified protein sequence (wt) from DENV-1__GQ868615__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3390 - protein, 3292 aa, Artificial Sequence
  derived and/or modified protein sequence (wt) from DENV-1__GU131749__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYRVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3391 - protein, 3292 aa, Artificial Sequence
  derived and/or modified protein sequence (wt) from DENV-1__GU131750__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSIEKAAEVSWEEEAEHSGASHNILVEVQDDGTMKIKDEERDDTLTILLKATLLAVSGVYPLSIPATLFVWYFWQKKKQRSGVLWDTPSPPEVGRAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLMQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDTMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3392 - protein, 3292 aa, Artificial Sequence
  derived and/or modified protein sequence (wt) from DENV-1__GU131751__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTIATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKVIRPQPMEHKYSWKSWGKAKIIGADVQNTTFIIDGPNTPECPDDQRAWNIWEVEDYGFGIFTTNIWLKLRDSYTQVCDHRLMSAAIRDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSKWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDIPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3393 - protein, 3292 aa, Artificial Sequence
  derived and/or modified protein sequence (wt) from DENV-1__GU131753__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIITDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAMKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVTASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVFDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3394 - protein, 3292 aa, Artificial Sequence
  derived and/or modified protein sequence (wt) from DENV-1__GU131754__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKDKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCMSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3395 - protein, 3292 aa, Artificial Sequence
  derived and/or modified protein sequence (wt) from DENV-1__GU131755__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKIRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3396 - protein, 3292 aa, Artificial Sequence
  derived and/or modified protein sequence (wt) from DENV-1__GU131756__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAAFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3397 - protein, 3292 aa, Artificial Sequence
  derived and/or modified protein sequence (wt) from DENV-1__GU131758__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDVPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSFTFIKTTFSLHYAWKTMAMVLSIVSLFPLCLSTTSQKTTWLPVLLGSLGCKPLTMFLIAENKVWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3398 - protein, 3292 aa, Artificial Sequence
  derived and/or modified protein sequence (wt) from DENV-1__GU131759__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSFTFIKTTFSLHYAWKTMAMVLSIVSLFPLCLSTTSQKTTWLPVLLGSLGCKPLTMFLIAENKVWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSHKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3399 - protein, 3292 aa, Artificial Sequence
  derived and/or modified protein sequence (wt) from DENV-1__GU131761__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMILSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIQDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3400 - protein, 3292 aa, Artificial Sequence
  derived and/or modified protein sequence (wt) from DENV-1__GU131762__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSMSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARVYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3401 - protein, 3292 aa, Artificial Sequence
  derived and/or modified protein sequence (wt) from DENV-1__GU131763__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGLGEVDSFSLGLLCISIMIEEVMRSRWSRKMLMAGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPERCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNKVWIEENPWMEDKTHVSSWGDVPYLGKREDQWCGSLIGLTARATWASNIQVAINQVRRLIGNENYLDYMTSMKRFKNEGDPEGALW

SEQ ID NO: 3402 - protein, 3292 aa, Artificial Sequence
  derived and/or modified protein sequence (wt) from DENV-1__GU131766__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESIEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVIDKEKPVNIEAEPPFGESYIVIGAGEKALKLSWFKKGSSIGKMFEATARGARRMAILGDTAWDFGSIGGVFTSIGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKMRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLCATLLSLTFIKTTLSLHYAWKTMAMVLSIVSLIPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYEKDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTVQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3403 - protein, 3292 aa, Artificial Sequence
  derived and/or modified protein sequence (wt) from DENV-1__GU131767__SS-prME
SVTMLLMLMPTALAFHLTTRGGEPHMIVSKQERGKSLLFKTSVGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVRADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3404 - protein, 3292 aa, Artificial Sequence
  derived and/or modified protein sequence (wt) from DENV-1__HM181967__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHMAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3405 - protein, 3292 aa, Artificial Sequence
  derived and/or modified protein sequence (wt) from DENV-1__GU131768__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCNWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVKKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITADDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3406 - protein, 3292 aa, Artificial Sequence
  derived and/or modified protein sequence (wt) from DENV-1__GU131770__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKIRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3407 - protein, 3292 aa, Artificial Sequence
  derived and/or modified protein sequence (wt) from DENV-1__GU131773__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCMTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFLLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3408 - protein, 3292 aa, Artificial Sequence
  derived and/or modified protein sequence (wt) from DENV-1__GU131775__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVVVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGGKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3409 - protein, 3292 aa, Artificial Sequence
  derived and/or modified protein sequence (wt) from DENV-1__GU131777__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3410 - protein, 3292 aa, Artificial Sequence
  derived and/or modified protein sequence (wt) from DENV-1__GU131778__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDIPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISRIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3411 - protein, 3292 aa, Artificial Sequence
  derived and/or modified protein sequence (wt) from DENV-1__GU131779__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVVSVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3412 - protein, 3292 aa, Artificial Sequence
  derived and/or modified protein sequence (wt) from DENV-1__GU131780__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFSGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLTVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETMMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3413 - protein, 3292 aa, Artificial Sequence
  derived and/or modified protein sequence (wt) from DENV-1__GU131781__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKDKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVVNWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCMSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLARSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3414 - protein, 3292 aa, Artificial Sequence
  derived and/or modified protein sequence (wt) from DENV-1__GU131782__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGLGEVDSFSLGLLCISIMIEEVMRSRWSRKMLMAGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQPHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPERCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3415 - protein, 3292 aa, Artificial Sequence
  derived and/or modified protein sequence (wt) from DENV-1__GU131784__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHHAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLARRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3416 - protein, 3292 aa, Artificial Sequence
  derived and/or modified protein sequence (wt) from DENV-1__JF937612__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNATFIIDGPNTPECPDDQRAWNIWEVEDYGFGIFTTNIWLKLRDSYTQVCDHRLMSAAIRDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3417 - protein, 3292 aa, Artificial Sequence
  derived and/or modified protein sequence (wt) from DENV-1__GU131786__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEAPARGARRMAILGATAWDFGSIGGVFPSVGKLVHQIFGTAYGVLFSGVSWTMKIGIGVLLTWLGLNSRSTSLSMTCIAVGLVTLYLGVMVRADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3418 - protein, 3292 aa, Artificial Sequence
  derived and/or modified protein sequence (wt) from DENV-1__GU131787__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENGMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLARSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3419 - protein, 3292 aa, Artificial Sequence
  derived and/or modified protein sequence (wt) from DENV-1__HM181968__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFATNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLLRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSFGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPIDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3420 - protein, 3292 aa, Artificial Sequence
  derived and/or modified protein sequence (wt) from DENV-1__GU131789__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPILAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3421 - protein, 3292 aa, Artificial Sequence
  derived and/or modified protein sequence (wt) from DENV-1__GU131790__SS-prME
SVTMLLMLVPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKLIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVKRLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3422 - protein, 3292 aa, Artificial Sequence
  derived and/or modified protein sequence (wt) from DENV-1__GU131791__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQAAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRRMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGPMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVILHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3423 - protein, 3292 aa, Artificial Sequence
  derived and/or modified protein sequence (wt) from DENV-1__GU131792__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVEPWALRHPGFTVIALFLAHAIGTSITQKGIIFILLMLVTPSMAMRCVGIGSRAFVEGLSGATWVDVVLEHGSCVTTMAKDKPTLDIELLKTEVTNPAVLRKLCIEAKISNTTTDSRCPTQGEATLMEEQDATFVCRRTFVDRGWGNGCGLFGKGSLITCAKFKCVTKLEGKIVQYENLKYSVIVTVHTGDQHQVGNESTEHGTTATITPQAPTSEIQLPDYGALTLDCSPRTGLDFNEMVLLTMKEKSWLVHKQWFLDLPLPWTSGASTSQETWNRQDLLVTFKTAHAKKQEVVVLGSQEGAMHTGLTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFGTNEVHTWTEQYKFQADSPKRLSAAIGKPWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSHTQVCDHRLMAAAIKDRKAVHADMGYWIESEKNEPWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLITENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLARSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 3424 - protein, 3292 aa, Artificial Sequence
  derived and/or modified protein sequence (wt) from DENV-1__HM488256__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLPDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGAPAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWAKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEISPVKEKEENLVKSMVSAGSGEVDSFSLGLLCISIMIEEVMRSRWSRKMLMTGTLAVFFLLIVGQLPWNDLIRLCIMVGATASARMGMGTTSLALMATFKMRPMFAVGLLFRRLTSREVLLLTIGLSLVASVELPNSLEELGDGLAMGIMILKLLTDFQSHQLWATLLSLTFIKTTFSLHYAWKTMAMGLSVVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3425 - protein, 3292 aa, Artificial Sequence
  derived and/or modified protein sequence (wt) from DENV-1__GU131793__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSTTQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3426 - protein, 3292 aa, Artificial Sequence
  derived and/or modified protein sequence (wt) from DENV-1__GU131794__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3427 - protein, 3292 aa, Artificial Sequence
  derived and/or modified protein sequence (wt) from DENV-1__GU131796__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCVEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTSSLHYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3428 - protein, 3292 aa, Artificial Sequence
  derived and/or modified protein sequence (wt) from DENV-1__GU131797__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3429 - protein, 3292 aa, Artificial Sequence
  derived and/or modified protein sequence (wt) from DENV-1__GU131801__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIGIGAGEKALKLSWVKKGSSIGKMVEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAGRVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 3430 - protein, 3292 aa, Artificial Sequence
  derived and/or modified protein sequence (wt) from DENV-1__GU131804__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHAAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANIDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3431 - protein, 3292 aa, Artificial Sequence
  derived and/or modified protein sequence (wt) from DENV-1__GU131805__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSPEIQLPDYGALTLDCSPRPGLDFNEMVLLPMKEKSWLVHKQWFLDLPLPWTSGASTSQETWNRKDLLGTFKTAHAKEQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPAFGESYIVIGAGEKALKLSWVKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFGTNEVHTWTEQYKFQADSPKRLSAAIGKAWEEGVCGIRSATRLENIMWKQISNELNHILLENAMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNEPWKLARASFIEVKTCIWPKSHTLWSNGVLESEMIIPKIYGGPISQHNYRPGYFTQTAGPWHLGKLELDFDLCEGTTVVVDEHCGNRGPSLRTTTVPGKIIHEWCCRSCTLPPLRFKGEDGCWYGMEISPVKEKEENLVKSMVSAGSGEVDSFSLGLLCISIMIEEVMRSRWSRKMLMTGPLPVFFLLIMGQLPWNDLIRLCIMVGANASDRMGMGTPYLALMATFKMRPMFAVGLLFRRLTSREGLLLTIGLSLVASVELPNSLEELGDGLAMGIMILKLLTDFQSHQLWATLLALTFIKTTFSLDYAWKTMAMVLSIVSLFPLCLSTTSQKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGGSHNILVEVQDDGTMKIKDEERDATLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3432 - protein, 3292 aa, Artificial Sequence
  derived and/or modified protein sequence (wt) from DENV-1__GU131806__SS-prME
SVTMFLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLAWTSGGSTSQETWNRQDLVVTFKTAHGKKQEVVVLGSQEGAMHTALTGATEIQTSGTTTIFAGHLKCRLKMDKLTLKGMSYVMCTGSFKLEKELAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLAKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGPSHNILVEVQDDGPMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKILGLYGNGVVTTSGTYVSAIAQARASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3433 - protein, 3292 aa, Artificial Sequence
  derived and/or modified protein sequence (wt) from DENV-1__GU131807__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKPEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLVTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLRGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGPAYGVLFSGVSWPMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDDHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKIRPMFAVGLLFRRLTSREVLLLTIGLSLVASVELPNSLEELGDGLAMGIMILKLLTDFQSHQLWATLLSLTFIKTTFSLHCAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGEKNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDKQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3434 - protein, 3292 aa, Artificial Sequence
  derived and/or modified protein sequence (wt) from DENV-1__GU131811__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQIGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGVGEKALKLSWFKKGSSIGKMFETTARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSMTFIRTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKVVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLLGNENYLDYMTSMKRFKNESDPEGALW

SEQ ID NO: 3435 - protein, 3293 aa, Artificial Sequence
  derived and/or modified protein sequence (wt) from DENV-1__JF937615__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTDPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTDSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLIDFQSHQLWATLLSLTFIKTTFSLHYAWKTMAMVLSIVSLFPLLPVHDLPKKTTWLPVLLGSLGCKPLTMFLIAENKIWGRKSWPLNEGIMAVGIVSILLSALLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMFLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3436 - protein, 3292 aa, Artificial Sequence
  derived and/or modified protein sequence (wt) from DENV-1__GU131814__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHESTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3437 - protein, 3292 aa, Artificial Sequence
  derived and/or modified protein sequence (wt) from DENV-1__GU131815__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTRLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYITIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAASGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSVAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3438 - protein, 3292 aa, Artificial Sequence
  derived and/or modified protein sequence (wt) from DENV-1__GU131818__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKTVQHENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLVLCTSQILLMRTTWALCESITLATGPLTTLWEGSPGKFWNTTIAVSMANIFRGSYLAGASLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEEIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 3439 - protein, 3292 aa, Artificial Sequence
  derived and/or modified protein sequence (wt) from DENV-1__GU131820__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGLGEVDSFSLGLLCISIMIEEVMRSRWSRKMLMAGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHYAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPERCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW
